United States Patent 12,569,549 (FLAVIVIRUS VACCINE) - sequence listing, part 23

SEQ ID NO: 10036 - RNA, 9873 nt, synthetic construct
  misc_feature 1..9873: note = derived and/or modified CDS sequence (opt1) from DENV-3__HQ705609__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcgtgaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgaaggagctgaagtactcctggaagacctgggggaaggccaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggcggggcccatctcccagcacaaccaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtcggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtggcctggcgcaccgccaccctgatcctcgccggggtcagcctgctgccggtgtgccagtccagctccatgcggaagaccgactggctccccatggcggtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacatcacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtcccctcccacctcgcccaccgcacccggaacgccctggacaacctggtgatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccaccaagcgggacctgggcatgtccaaggagccgggggtggtcagccccacgtcctacctggacgtggacctccaccccgccagcgcctggaccctgtacgccgtggcgaccaccgtcatcacgcccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccatcgtcgaggagagccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgtcccgcaacagcacgcacgagatgtactggatctccaacggcaccgggaacatcgtcgccagcgtgaacatggtgtcccggctcctgctgaaccgcttcaccatgacccaccggcgcccgacgatcgagaaggacgtcgacctcggcgcgggcacccggcacgtgaacgccgagcccgagacccccaacatggacgtgatcggggagcgcatcaagcggatcaaggaggagcacaacagcacctggcactacgacgacgagaacccgtacaagacgtgggcctaccacggctcctacgaggtcaaggccaccgggagcgcctccagcatgatcaacggcgtggtcaagctgctgaccaagccctgggacgtggtgcccatggtcacccagatggcgatgacggacaccacccccttcgggcagcagcgcgtgttccgggagaaggtggacacccgcacgccgcggagcatgcccggcacccgccgggtcatgggcatcaccgccgagtggctctggcgcaccctggggcggaacaagaagccccgcctgtgcacgcgcgaggagttcaccaagaaggtgcggaccaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacgtaccagaacaaggtggtgaaggtccagcggcccacccccaccggcaccgtgatggacatcatcagccgcaaggaccagcggggctccggccaggtgggcacctacgggctgaacacgttcaccaacatggaggcccagctcatccgccagatggagggcgagggggtcctgagcaaggccgacctggagaacccccacctcccggagaagaagatcacccagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctcaaggagacggcctgcctgggcaaggcctacgcccagatgtggagcctgatgtacttccaccgccgggacctccgcctggcgtccaacgccatctgcagcgccgtgcccgtccactgggtgccgacctcccggaccacctggagcatccacgcccaccaccagtggatgacgaccgaggacatgctgaccgtgtggaaccgcgtctggatcgaggacaacccctggatggaggacaagacccccgtgacgacctgggagaacgtgccctacctcgggaagcgggaggaccagtggtgcggcagcctgatcgggctgacctcccgcgccacctgggcgcagaacatcccgacggccatccagcaggtccggagcctcatcggcaacgaggagttcctggactacatgccctccatgaagcgcttccggaaggaggaggagagcgagggggccatctggtga

SEQ ID NO: 10037 - RNA, 9873 nt, synthetic construct
  misc_feature 1..9873: note = derived and/or modified CDS sequence (opt1) from DENV-3__HQ705610__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccatctggagcaacggcgtgctcgagtccgacatgatcatccccaagagcctggcggggcccatctcccagcacaaccaccggccgggctaccacacccagacggccgggccctggcacctgggcaagctcgagctggacttcaactactgcgagggcaccaccgtcgtgatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtgtccgccggcagcgggaaggtggacaacttcaccatgggcgtcctgtgcctggccatcctcttcgaggaggtgatgcgggggaagttcggcaagaagcacatgatcgccggggtgttcctgaccttcgtcctgctcctgtccggccagatcacctggaaggacatggcgcacacgctgatcatgatcggcagcaacgcctccgaccgcatggggatgggcgtgacctacctcgccctgatcgccaccttcaagatccagcccttcctggccctcgggttcttcctgcggaagctgaccagccgcgagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcagcaccctgacggtcgcctggcggaccgccaccctgatcctcgccggggtgtccctgctgccggtctgccagagctccagcatgcgcaagaccgactggctccccatggcggtggccgccatgggcgtgccgcccctcccgctgttcatcttctccctcaaggacacgctgaagcggcgcagctggcccctgaacgagggggtcatggccgtgggcctcgtgtccatcctggccagctccctgctccgcaacgacgtccccatggcgggccccctggtggccgggggcctgctcatcgcctgctacgtgatcaccgggaccagcgccgacctgaccgtcgagaaggccgcggacatcacgtgggaggaggaggccgagcagaccggcgtgtcccacaacctgatgatcaccgtggacgacgacgggaccatgcggatcaaggacgacgagaccgagaacatcctcacggtcctgctgaagaccgccctcctgatcgtgagcggcatcttcccgtactccatccccgccaccctgctcgtgtggcacacctggcagaagcagacgcagcgcagcggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgcggtgctcacctacaacgggaagcggctggagcccaactgggccagcgtcaagaaggacctgatctcctacggcgggggctggcgcctcagcgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggctcccccatcatcaaccgggagggcaaggtggtggggctgtacggcaacggggtcgtgacgaagaacggcgggtacgtgagcggcatcgcccagaccaacgccgagccggacggccccacccccgagctggaggaggagatgttcaagaagcgcaacctcaccatcatggacctgcaccccgggtccggcaagacgcggaagtacctgccggccatcgtccgcgaggcgatcaagcggcgcctccggaccctgatcctggcccccacccgcgtggtggccgccgagatggaggaggccctcaaggggctgcccatccggtaccagaccacggcgaccaagagcgagcacaccggccgcgagatcgtcgacctgatgtgccacgccaccttcacgatgcggctcctgtcccccgtgcgcgtgccgaactacaacctgatcatcatggacgaggcccacttcaccgaccccgccagcatcgccgcgcgggggtacatctccacccgcgtcggcatgggcgaggccgccgccatcttcatgaccgcgacgccgcccgggaccgccgacgccttcccgcagagcaacgcccccatccaggacgaggagcgggacatccccgagcgctcctggaacagcggcaacgagtggatcaccgacttcgccgggaagaccgtgtggttcgtgccctccatcaaggcgggcaacgacatcgccaactgcctccgcaagaacgggaagaaggtcatccagctgagccggaagacgttcgacaccgagtaccagaagaccaagctgaacgactgggacttcgtggtgaccacggacatctccgagatgggcgccaacttcaaggccgaccgcgtcatcgacccgcggcgctgcctcaagcccgtgatcctgaccgacggccccgagcgggtgatcctggccgggcccatgccggtcaccgcggccagcgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagagccgcaagaccttcgtggagctgatgcggcgcggggacctccccgtctggctggcgcacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccggacgtacagcgacccgctggccctcaaggagttcaaggagttcgccgcgggccgcaagtccatcgccctggacctggtgaccgagatcgggcgcgtgcccagccacctcgcccaccggacccgcaacgccctggacaacctggtcatgctccacaccagcgagcacggcgggcgggcctaccgccacgcggtggaggagctgcccgagacgatggagaccctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccaccaagcgcgacctgggcatgagcaaggagccgggggtggtgtcccccacgagctacctggacgtcgacctccaccccgcctccgcctggaccctgtacgccgtggcgaccaccgtgatcacgcccatgctgcggcacaccatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgaccctgacggccgccgtgctcctgctgatcacccactacgccatcatcggccccggcctccaggcgaaggccacccgcgaggcccagaagcggaccgccgccgggatcatgaagaacccgacggtcgacggcatcatgaccatcgacctggaccccgtgatctacgacagcaagttcgagaagcagctgggccaggtgatgctcctggtcctgtgcgtggtgcagctcctgctgatgcgcacctcctgggcgctctgcgaggccctgaccctggccacgggccccatcaccaccctctgggagggcagccccgggaagttctggaacaccacgatcgccgtctccatggcgaacatcttccggggcagctacctggccggggccggcctggccttctccatcatgaagtccgtggggaccggcaagcgcggcaccgggagccagggcgagaccctcggggagaagtggaagaagaagctgaaccagctgtcccggaaggacttcgacctctacaagaagtccggcatcaccgaggtggaccgcacggaggccaaggaggggctgaagcggggcgagatcacccaccacgcggtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcaccatgacgcaccgccggccgaccatcgagaaggacgtcgacctcggcgccggcacccgccacgtgaacgcggagcccgagacccccaacatggacgtgatcggggagcggatcaagcgcatcaaggaggagcacaactccacgtggcactacgacgacgagaacccgtacaagacctgggcctaccacggcagctacgaggtcaaggccaccgggtccgccagcagcatgatcaacggcgtggtcaagctgctgaccaagccctgggacgtggtgcccatggtcacgcagatggccatgaccgacaccacccccttcgggcagcagcgggtgttcaaggagaaggtggacacgcgcaccccgcggtccatgcccggcacccgccgggtcatgggcatcaccgcggagtggctctggcgcacgctggggcggaacaagaagccccgcctgtgcacccgggaggagttcaccaagaaggtgcgcaccaacgccgccatgggcgccgtgttcacggaggagaaccagtgggacagcgcgaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtggtgaaggtccagcggcccacccccaccggcaccgtgatggacatcatctcccgcaaggaccagcggggcagcggccaggtgggcacgtacgggctgaacaccttcaccaacatggaggcccagctcatccgccagatggagggcgagggggtcctgtccaaggccgacctggagaacccccacctcccggagaagaagatcacccagtggctggagacgaagggcgtggagcggctgaagcgcatggccatcagcggcgacgactgcgtggtcaagcccatcgacgaccggttcgcgaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggccggctggagcctcaaggagaccgcgtgcctgggcaaggcctacgcccagatgtggtccctgatgtacttccaccggcgcgacctccgcctggccagcaacgcgatctgctccgccgtgcccgtccactgggtgccgaccagccggaccacgtggagcatccacgcccaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggctccctgatcgggctgaccagccgcgccacgtgggcccagaacatcccgaccgcgatccagcaggtccggtccctcatcggcaacgaggagttcctggactacatgcccagcatgaagcgcttccggaaggaggaggagtccgagggggccatctggtga

SEQ ID NO: 10038 - RNA, 9873 nt, synthetic construct
  misc_feature 1..9873: note = derived and/or modified CDS sequence (opt1) from DENV-3__HQ705611__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcaccatgacgcaccggcgcccgaccatcgagaaggacgtggacctcggcgcggggacccggcacgtcaacgccgagcccgagacccccaacatggacgtgatcggcgagcgcatcaagaagatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggcgatgaccgacaccacccccttcggccagcagcgggtcttcaaggagaaggtggacacgcgcaccccgcggagcatgcccggcacccgccgggtgatggggatcaccgccgagtggctctggcgcacgctgggccggaacaagaagccccgcctgtgcacccgggaggagttcaccaagaaggtccgcaccaacgccgccatgggggcggtgttcacggaggagaaccagtgggacagcgccaaggccgccgtggaggacgaggacttctggaagctcgtcgaccgcgagcgggagctgcacaagctgggcaagtgcgggtcctgcgtgtacaacatgatgggcaagcgcgagaagaagctcggcgagttcgggaaggccaagggcagccgggcgatctggtacatgtggctgggggcccgctacctggagttcgaggccctcggcttcctgaacgaggaccactggttctcccgggagaacagctactccggggtggagggcgagggcctgcacaagctcgggtacatcctgcgcgacatcagcaagatccccggcggggccatgtacgccgacgacaccgcgggctgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatctcccgcaaggaccagcgggggagcggccaggtggggacgtacggcctgaacaccttcaccaacatggaggcccagctcatccgccagatggagggggagggcgtgctgtccaaggccgacctggagaacccccacctcccggagaagaagatcacccagtggctggagacgaagggcgtcgagcggctgaagcgcatggcgatcagcggggacgactgcgtggtgaagcccatcgacgaccggttcgccaacgccctcctggccctgaacgacatgggcaaggtccgcaaggacatcccccagtggcagccctccaaggggtggcacgactggcagcaggtcccgttctgcagccaccacttccacgagctcatcatgaaggacggccggaagctggtggtcccctgccgcccccaggacgagctgatcgggcgggcccgcatctcccagggcgcgggctggagcctcaaggagaccgcctgcctggggaaggcctacgcccagatgtggtccctgatgtacttccaccggcgcgacctccgcctggcgagcaacgccatctgctccgccgtgcccgtgcactgggtcccgaccagccggaccacgtggtccatccacgcccaccaccagtggatgaccaccgaggacatgctgaccgtgtggaaccgcgtgtggatcgaggacaacccctggatggaggacaagacgcccgtcaccacctgggagaacgtgccctacctcggcaagcgggaggaccagtggtgcgggagcctgatcggcctgaccagccgcgccacgtgggcgcagaacatcccgaccgccatccagcaggtccggtccctcatcgggaacgaggagttcctggactacatgcccagcatgaagcgcttccggaaggaggaggagtccgagggcgccatctggtga

SEQ ID NO: 10039 - RNA, 9873 nt, synthetic construct
  misc_feature 1..9873: note = derived and/or modified CDS sequence (opt1) from DENV-3__HQ705612__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacacgacctgggaggaggaggccgagcagaccggggtgtcccacaacctgatgatcaccgtggacgacgacggcaccatgcgcatcaaggacgacgagacggagaacatcctcaccgtcctgctgaagaccgccctcctgatcgtgagcggcatcttcccgtactccatccccgccaccctgctcgtgtggcacacgtggcagaagcagacccagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacacgatgtggcacgtgacccgcggggcggtgctcacccacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggacgttccagaccaccaccggcgagatcggggcgatcgccctggacttcaagcccggcacgtccggcagccccatcatcaaccgcgaggggaaggtggtgggcctgtacgggaacggcgtcgtgaccaagaacgggggctacgtgagcggcatcgcccagaccaacgccgagccggacgggcccacccccgagctggaggaggagatgttcaagaagcggaacctcacgatcatggacctgcaccccggctccgggaagacccgcaagtacctgccggccatcgtccgggaggcgatcaagcgccggctccgcaccctgatcctggcccccacccgggtggtggccgccgagatggaggaggccctcaagggcctgcccatccgctaccagacgaccgcgaccaagagcgagcacaccgggcgggagatcgtcgacctgatgtgccacgccacgttcaccatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgacggcgacgccgcccggcaccgccgacgccttcccgcagagcaacgcccccatccaggacgaggagcgcgacatccccgagcgctcctggaacagcgggaacgagtggatcaccgacttcgccggcaagacggtgtggttcgtgccctccatcaaggcggggaacgacatcgccaactgcctccggaagaacggcaagaaggtcatccagctgagccgcaagaccttcgacaccgagtaccagaagaccaagctgaacgactgggacttcgtggtgacgaccgacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggacggaggcgaagatgctgctggacaacatcaacacccccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggacgaaggagggcgagaagaagaagctccgcccccggtggctggacgcccgcacctacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacgtccgagcacgggggccgcgcctaccggcacgcggtggaggagctgcccgagaccatggagaccctgctcctgctggggctcatgatcctgctgaccggcggcgccatgctgttcctgatcagcgggaagggcatcgggaagacgagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccacgaagcgggacctggggatgagcaaggagccgggcgtggtgtcccccaccagctacctggacgtcgacctccaccccgcctccgcctggaccctgtacgccgtggcgaccacggtgatcacccccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgacgctgaccgccgccgtgctcctgctgatcacccactacgccatcatcggccccgggctccaggcgaaggccacccgggaggcccagaagcgcacggccgccggcatcatgaagaacccgaccgtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgacgctggccaccggccccatcaccaccctctgggaggggagccccggcaagttctggaacacgaccatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcacggaggtggaccggaccgaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacacgaagggcgggcccggccacgaggagcccgtgcccatgagcacctacgggtggaacatcgtcaagctgatgtccggcaaggacgtgttctacctcccgcccgagaagtgcgacaccctgctgtgcgacatcggcgagagctcccccagccccaccgtggaggagtcccgcacgatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcacgatgacccaccggcgcccgaccatcgagaaggacgtggacctcggcgcggggacccggcacgtcaacgccgagcccgagacgcccaacatggacgtgatcggcgagcgcatcaagcggatcaaggaggagcacaactccacctggcactacgacgacgagaacccgtacaagacctgggcctaccacgggagctacgaggtgaaggccaccggctccgccagctccatgatcaacggggtcgtgaagctgctgacgaagccctgggacgtcgtgcccatggtgacccagatggcgatgaccgacaccacgcccttcggccagcagcgcgtcttcaaggagaaggtggacacccggaccccgcgcagcatgcccggcacccggcgcgtgatggggatcacggccgagtggctctggcggaccctgggccgcaacaagaagccccggctgtgcacccgcgaggagttcaccaagaaggtccgcacgaacgccgccatgggggcggtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtcgtgaaggtgcagcgccccacccccaccggcacggtcatggacatcatctcccggaaggaccagcgcgggagcggccaggtggggacctacggcctgaacaccttcaccaacatggaggcccagctcatccggcagatggagggggagggcgtgctgtccaaggccgacctggagaacccccacctcccggagaagaagatcacgcagtggctggagaccaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcggcaagcgcgaggaccagtggtgcgggagcctgatcggcctgacgagccgggccacctgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10040 - RNA, 9873 nt, synthetic construct
  misc_feature 1..9873: note = derived and/or modified CDS sequence (opt1) from DENV-3__HQ705613__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaactaccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgacccgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgacggcgacgccgcccggcaccgccgacgccttcccgcagagcaacgcccccatccaggacgaggagcgcgacatccccgagcgctcctggaacagcgggaacgagtggatcaccgacttcgccggcaagacggtgtggttcgtgccctccatcaaggcggggaacgacatcgccaactgcctccggaagaacggcaagaaggtcatccagctgagccgcaagaccttcgacaccgagtaccagaagaccaagctgaacgactgggacttcgtggtgacgaccgacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggacggaggcgaagatgctgctggacaacatcaacacccccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggacgaaggagggcgagaagaagaagctccgcccccggtggctggacgcccgcacctacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacgtccgagcacgggggccgcgcctaccggcacgcggtggaggagctgcccgagaccatggagaccctgctcctgctggggctcatgatcctgctgaccggcggcgccatgctgttcctgatcagcgggaagggcatcgggaagacgagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccacgaagcgggacctggggatgagcaaggagccgggcgtggtgtcccccaccagctacctggacgtcgacctccaccccgcctccgcctggaccctgtacgccgtggcgaccacggtgatcacccccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgacgctgaccgccgccgtgctcctgctgatcacccactacgccatcatcggccccgggctccaggcgaaggccacccgggaggcccagaagcgcacggccgccggcatcatgaagaacccgaccgtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgacgctggccaccggccccatcaccaccctctgggaggggagccccggcaagttctggaacacgaccatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcacggaggtggaccggaccgaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacacgaagggcgggcccggccacgaggagcccgtgcccatgagcacctacgggtggaacatcgtcaagctgatgtccggcaaggacgtgttctacctcccgcccgagaagtgcgacaccctgctgtgcgacatcggcgagagctcccccagccccaccgtggaggagtcccgcacgatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcacgatgacccaccggcgcccgaccatcgagaaggacgtggacctcggcgcggggacccggcacgtcaacgccgagcccgagacgcccaacatggacgtgatcggcgagcgcatcaagcggatcaaggaggagcacaactccacctggcactacgacgacgagaacccgtacaagacctgggcctaccacgggagctacgaggtgaaggccaccggctccgccagctccatgatcaacggggtcgtgaagctgctgacgaagccctgggacgtcgtgcccatggtgacccagatggcgatgaccgacaccacgcccttcggccagcagcgcgtcttcaaggagaaggtggacacccggaccccgcgcagcatgcccggcacccggcgcgtgatggggatcacggccgagtggctctggcggaccctgggccgcaacaagaagccccggctgtgcacccgcgaggagttcaccaagaaggtccgcacgaacgccgccatgggggcggtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtcgtgaaggtgcagcgccccacccccaccggcacggtcatggacatcatctcccggaaggaccagcgcgggagcggccaggtggggacctacggcctgaacaccttcaccaacatggaggcccagctcatccggcagatggagggggagggcgtgctgtccaaggccgacctggagaacccccacctcccggagaagaagatcacgcagtggctggagaccaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcggcaagcgcgaggaccagtggtgcgggagcctgatcggcctgacgagccgggccacctgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10041 - RNA, 9873 nt, synthetic construct
  misc_feature 1..9873: note = derived and/or modified CDS sequence (opt1) from DENV-3__HQ705615__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcgccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggagttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcaccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctaccactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgacgacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10042 - RNA, 9873 nt, synthetic construct
  misc_feature 1..9873: note = derived and/or modified CDS sequence (opt1) from DENV-3__JF920398__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccatctggagcaacggcgtgctcgagtccgacatgatcatccccaagagcctggcggggcccatctcccagcacaaccaccggccgggctaccacacccagacggccgggccctggcacctgggcaagctcgagctggacttcaactactgcgagggcaccaccgtcgtgatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtgtccgccggcagcgggaaggtggacaacttcaccatgggcgtcctgtgcctggccatcctcttcgaggaggtgatgcgggggaagttcggcaagaagcacatgatcgccggggtgttcctgaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggagttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10043 - RNA, 9873 nt, synthetic construct
  misc_feature 1..9873: note = derived and/or modified CDS sequence (opt1) from DENV-3__JF920402__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcggggcccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagatctaccagctgtggaccgccctgatcagcctgacctgctccaacacgatcttcaccctgaccgtcgcctggcgcaccgccacgctgatcctcgcgggggtgagcctgctgccgatgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacgtccgccgacctgaccgtggagaaggcggccgacatcacctgggaggaggaggccgagcagaccggcgtcagccacaacctgatgatcacggtggacgacgacgggaccatgcgcatcaaggacgacgagaccgagaacatcctcaccgtgctgctgaagaccgccctcctgatcgtctccggcatcttcccgtacagcatccccgccacgctgctcgtgtggcacacctggcagaagcagacccagcggtccggcgtgctgtgggacgtccccagcccgcccgagacccagaaggcggagctggaggagggggtgtaccgcatcaagcagcagggcatcttcgggaagacccaggtgggcgtcggggtgcagaaggagggcgtgttccacaccatgtggcacgtcacccggggcgccgtgctcacctacaacgggaagcgcctggagcccaactgggcctccgtgaagaaggacctgatcagctacggcgggggctggcggctctccgcccagtggcagaagggggaggaggtccaggtgatcgcggtggagcccggcaagaaccccaagaacttccagacgatgcccggcaccttccagaccaccacgggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagaccaacgccgagccggacggccccacgcccgagctggaggaggagatgttcaagaagcggaacctcaccatcatggacctgcaccccgggagcggcaagacccgcaagtacctgccggcgatcgtgcgggaggccatcaagcgccggctccgcaccctgatcctggcccccacgcgggtcgtggccgccgagatggaggaggcgctcaaggggctgcccatccgctaccagaccaccgccaccaagtccgagcacacgggccgggagatcgtggacctgatgtgccacgccaccttcaccatgcgcctcctgagccccgtccgggtgccgaactacaacctgatcatcatggacgaggcccacttcaccgaccccgcctccatcgcggcccgcgggtacatcagcacgcgggtgggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcacggacttcgcggggaagaccgtctggttcgtgcccagcatcaaggccggcaacgacatcgccaactgcctccggaagaacgggaagaaggtgatccagctgtcccgcaagaccttcgacaccgagtaccagaagacgaagctgaacgactgggacttcgtcgtgaccaccgacatcagcgagatgggcgccaacttcaaggccgaccgggtgatcgacccgcgccggtgcctcaagcccgtcatcctgaccgacggccccgagcgcgtgatcctggcggggcccatgccggtgacggccgcctccgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggagttcgcggccggccgcaagagcatcgccctggacctggtcaccgagatcgggcgggtgccctcccacctcgcccaccgcacgcggaacgccctggacaacctggtgatgctccacaccagcgagcacggcgggcgcgcgtaccggcacgccgtcgaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccctggccgccatcatcgcggccaacgagatgggcctgctcgagacgaccaagcgggacctgggcatgtccaaggagccgggggtcgtgagccccacctcctacctggacgtggacctccaccccgccagcgcctggaccctgtacgcggtcgccacgaccgtgatcacccccatgctgcgccacaccatcgagaactccacggccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgaccgccgccgtgctcctgctgatcacccactacgcgatcatcggccccggcctccaggccaaggccacgcgggaggcccagaagcgcaccgccgcggggatcatgaagaacccgaccgtggacggcatcatgaccatcgacctggaccccgtcatctacgactccaagttcgagaagcagctgggccaggtgatgctcctggtgctgtgcgtcgtgcagctcctgctgatgcggacgagctgggccctctgcgaggccctgaccctggccaccggccccatcaccacgctctgggagggctcccccgggaagttctggaacaccaccatcgcggtgagcatggccaacatcttccgcggctcctacctggccggggccggcctggccttcagcatcatgaagtccgtcgggaccggcaagcggggcacggggagccagggcgagaccctcggggagaagtggaagaagaagctgaaccagctgagccgcaaggacttcgacctctacaagaagtccggcatcaccgaggtggaccggaccgaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcacggaggtgcggggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacccacgagatgtactggatctccaacggcacggggaacatcgtggccagcgtcaacatggtgtcccggctcctgctgaaccgcttcaccatgacccaccggcgcccgaccatcgagaaggacgtggacctcggcgcgggcacgcggcacgtcaacgccgagcccgagacccccaacatggacgtgatcggggagcgcatcaagcggatcaaggaggagcacaacagcacctggcactacgacgacgagaacccgtacaagacctgggcctaccacggctcctacgaggtgaaggccacggggagcgcctccagcatgatcaacggcgtcgtgaagctgctgaccaagccctgggacgtcgtgcccatggtgacccagatggcgatgaccgacacgacccccttcgggcagcagcgcgtcttcaaggagaaggtggacacccggaccccgcgcagcatgcccggcacgcggcgcgtgatgggcatcaccgccgagtggctctggcggaccctggggcgcaacaagaagccccggctgtgcacccgcgaggagttcacgaagaaggtccgcaccaacgccgccatgggcgcggtgttcaccgaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacgcgcatcaccgaggacgacctgcacaacgaggagaagatcacccagcagatggacccggagcaccggcagctcgccaacgccatcttcaagctgacctaccagaacaaggtcgtgaaggtgcagcgccccacgcccaccggcaccgtcatggacatcatcagccggaaggaccagcgcggctccggccaggtgggcacctacgggctgaacaccttcacgaacatggaggcccagctcatccggcagatggagggcgagggggtgctgagcaaggccgacctggagaacccccacctcccggagaagaagatcacccagtggctggagaccaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacgtcccgcaccacctggagcatccacgcccaccaccagtggatgaccacggaggacatgctgaccgtgtggaaccgggtgtggatcgaggacaacccctggatggaggacaagacccccgtcaccacgtgggagaacgtgccctacctcgggaagcgcgaggaccagtggtgcggcagcctgatcgggctgacctcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10044 - RNA, 9873 nt, synthetic construct
  misc_feature 1..9873: note = derived and/or modified CDS sequence (opt1) from DENV-3__JF937652__SS-prME
  source 1..9873: mol_type = other RNA
accagcctgtgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacaacaccgtgacctacaagtgcccccacatcaccgaggtggagcccgaggacatcgactgctggtgcaacctgaccagcacctgggtgacctacgggacgtgcaaccaggccggcgagcaccggcgggacaagcggtccgtggccctcgcgccccacgtgggcatggggctggacacccgcacccagacctggatgagcgccgagggcgcctggcggcaggtcgagaaggtcgagacgtgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgcccgaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcggtcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagctggtcaacatcgaggccgagcccccgttcggggagagcaacatcgtgatcggcatcggggacaacgccctgaagatcaactggtacaagaagggctccagcatcgggaagatgttcgaggcgaccgcccggggcgcccgccggatggccatcctcggcgacacggcctgggacttcgggtccgtgggcggggtcctgaacagcctgggcaagatggtgcaccagatcttcgggtccgcgtacaccgccctcttcagcggcgtgtcctgggtcatgaagatcggcatcggggtgctgctgacctggatcggcctcaacagcaagaacacctccatgagcttctcctgcatcgccatcgggatcatcacgctgtacctgggcgccgtggtccaggccgacatggggtgcgtgatcaactggaagggcaaggagctcaagtgcggcagcgggatcttcgtgaccaacgaggtccacacctggaccgagcagtacaagttccaggcggactcccccaagcgcctggccacggccatcgccggcgcctgggagaacggggtgtgcggcatccgcagcaccacccggatggagaacctgctctggaagcagatcgcgaacgagctgaactacatcctgtgggagaacaacatcaagctcaccgtggtcgtgggggacatcatcggcgtgctggagcagggcaagcgcacgctgacgccccagcccatggagctcaagtactcctggaagacctgggggaaggccaagatcgtcaccgccgagacgcagaacagctccttcatcatcgacggcccgaacacccccgagtgccccagcgtgtcccgggcctggaacgtgtgggaggtcgaggactacgggttcggcgtgttcaccaccaacatctggctgaagctgcgcgaggtgtacacccagctctgcgaccaccggctgatgagcgcggccgtcaaggacgagcgcgccgtgcacgccgacatgggctactggatcgagagccagaagaacgggtcctggaagctggagaaggccagcctcatcgaggtgaagacgtgcacctggcccaagtcccacaccctgtggagcaacggcgtcctggagtccgacatgatcatccccaagagcctcgcggggcccatctcccagcacaactaccggcccggctaccacacccagacggccgggccgtggcacctgggcaagctggagctcgacttcaactactgcgagggcaccaccgtggtgatcaccgagaactgcgggacgcgcggccccagcctgcggaccaccaccgtctccgggaagctgatccacgagtggtgctgccgcagctgcacgctgccgcccctccggtacatgggcgaggacgggtgctggtacggcatggagatccgcccgatctccgagaaggaggagaacatggtcaagagcctggtgtccgccggcagcgggaaggtcgacaacttcaccatgggcgtgctctgcctggccatcctgttcgaggaggtgatgcgggggaagctcggcaagaagcacatgatcgccggggtcttcttcaccttcgtgctgctgctctccggccagatcacctggcgcgacatggcgcacacgctgatcatgatcggcagcaacgcctccgaccggatggggatgggcgtgacctacctggccctcatcgccaccttcaagatccagcccttcctggccctggggttcttcctccgcaagctgaccagccgggagaacctgctcctgggcgtcggcctggcgatggccacgaccctccagctgcccgaggacatcgagcagatggccaacgggatcgccctgggcctcatggcgctgaagctgatcacccagttcgagacctaccagctctggacggccctgatcagcctgacctgctccaacaccatcttcaccctcacggtggcctggcgcaccgccaccctgatcctggccggggtcagcctcctgcccgtgtgccagtccagctccatgcggaagaccgactggctgccgatggcggtggccgccatgggcgtgccgcccctgcccctgttcatcttcgggctgaaggacacgctcaagcgccgcagctggccgctgaacgagggcgtgatggccgtgggcctggtctccatcctcgccagctccctgctgcggaacgacgtgcccatggcggggcccctcgtggccggcgggctgctgatcgcctgctacgtcatcaccggcaccagcgccgacctcaccgtggagaaggccgcggacatcacgtgggaggaggaggccgagcagaccggggtgtcccacaacctgatgatcaccgtcgacgacgacggcaccatgcgcatcaaggacgacgagaccgagaacatcctgacggtgctcctgaagaccgccctgctcatcgtgagcggcatcttcccctactccatcccggccaccctgctggtctggcacacctggcagaagcagacgcagcggagcggggtgctctgggacgtgcccagcccgcccgagacccagaaggccgagctggaggagggcgtctaccgcatcaagcagcaggggatcttcggcaagacccaggtgggggtgggcgtccagaaggagggcgtgttccacaccatgtggcacgtgacgcgcggggcggtcctgacctacaacggcaagcgcctcgagccgaactgggccagcgtgaagaaggacctgatctcctacgggggcgggtggcggctgagcgcccagtggcagaagggcgaggaggtgcaggtcatcgccgtggagcccggcaagaaccccaagaacttccagaccatgcccgggaccttccagacgaccaccggcgagatcggggcgatcgccctggacttcaagccgggcacctccggcagccccatcatcaaccgcgaggggaaggtggtcggcctctacgggaacggcgtggtgacgaagaacgggggctacgtcagcggcatcgcccagaccaacgccgagcccgacgggccgacccccgagctggaggaggagatgttcaagaagcggaacctgaccatcatggacctccaccccggctccgggaagacgcgcaagtacctgcccgccatcgtgcgggaggcgatcaagcgccggctgcgcaccctcatcctggccccgacccgggtggtcgccgccgagatggaggaggccctgaagggcctccccatccgctaccagaccacggcgaccaagagcgagcacaccgggcgggagatcgtggacctgatgtgccacgccaccttcacgatgcgcctgctctcccccgtgcgggtccccaactacaacctgatcatcatggacgaggcccacttcaccgacccggccagcatcgccgcgcgcggctacatctccacccgggtgggcatgggggaggccgccgccatcttcatgaccgcgacgccgcccggcaccgccgacgccttcccccagagcaacgccccgatccaggacgaggagaaggacatccccgagcgctcctggaacagcgggaacgagtggatcaccgacttcgccggcaagaccgtgtggttcgtcccctccatcaaggcggggaacgacatcgccaactgcctgcgcaagaacggcaagaaggtgatccagctcagccggaagacgttcgacaccgagtaccagaagaccaagctgaacgactgggacttcgtggtcaccacggacatctccgagatgggcgccaacttcaaggccgaccgcgtgatcgacccccggcgctgcctgaagccggtgatcctcaccgacgggcccgagcgggtcatcctggccggccccatgcccgtgaccgcggccagcgccgcccagcgccgggggcgcgtgggccggaacccgcagaaggagaacgaccagtacatcttcaccgggcagcccctgaacaacgacgaggaccacgcccactggaccgaggcgaagatgctcctggacaacatcaacacgcccgagggcatcatccccgccctgttcgagccggagcgcgagaagtccgccgccatcgacggcgagtaccggctcaagggggagagccgcaagaccttcgtcgagctgatgcggcgcggcgacctgcccgtgtggctcgcgcacaaggtcgcctccgaggggatcaagtacaccgaccggaagtggtgcttcgacggccagcgcaacaaccagatcctggaggagaacatggacgtggagatctggaccaaggagggcgagaagaagaagctgcggccccgctggctcgacgcccggacgtacagcgaccccctggccctgaaggagttcaaggagttcgccgcggggcgcaagtccatcgccctcgacctggtgaccgagatcggccgcgtcccgagccacctggcccaccggacccgcaacgccctcgacaacctggtgatgctgcacacctccgagcacgggggccgggcctaccgccacgcggtggaggagctccccgagacgatggagaccctgctgctcctggggctgatgatcctcctgaccggcggcgccatgctgttcctcatcagcgggaagggcatcgggaagaccagcatcggcctgatctgcgtcatcgcctccagcgggatgctgtggatggccgagatccccctccagtggatcgcctccgcgatcgtgctggagttcttcatgatggtgctgctcatcccggagcccgagaagcagcggacgccccaggacaaccagctggcctacgtcgtgatcggcatcctgaccctcgccgccatcatcgccgcgaacgagatgggcctgctggagaccaccaagcgcgacctcgggatgagcaaggagcccggcgtggtctccccgacgagctacctggacgtggacctgcaccccgcctccgcctggaccctctacgccgtggcgaccaccgtcatcacgcccatgctgcggcacaccatcgagaacagcaccgccaacgtgtccctggccgccatcgccaaccaggcggtggtcctcatggggctggacaagggctggcccatcagcaagatggacctgggggtgccgctcctggccctgggctgctactcccaggtgaaccccctcaccctgacggccgccgtcctgctcctgatcacccactacgccatcatcggccccgggctgcaggcgaaggccacccgcgaggcccagaagcggaccgccgccggcatcatgaagaaccccacggtggacgggatcatgaccatcgacctcgacccggtgatctacgacagcaagttcgagaagcagctgggccaggtcatgctgctcgtgctgtgcgcggtgcagctgctcctgatgcgcacctcctgggccctgtgcgaggccctcaccctggccacgggccccatcaccaccctgtgggaggggagccccggcaagttctggaacaccacgatcgcggtctccatggccaacatcttccgggggagctacctcgccggcgccgggctggccttctccatcatgaagtccgtgggcaccggcaagcgcgggaccggctcccagggggagaccctgggcgagaagtggaagaagaagctcaaccagctgagccggaaggacttcgacctgtacaagaagtccgggatcaccgaggtggaccgcacggaggcgaaggagggcctcaagcggggcgagatcacccaccacgccgtctcccgcgggagcgccaagctgcagtggttcgtggagcggaacatggtgatccccgagggccgcgtcatcgacctggggtgcggccgcgggggctggtcctactactgcgccggcctcaagaaggtgaccgaggtgcgcgggtacaccaagggcgggccgggccacgaggagcccgtccccatgagcacgtacgggtggaacatcgtgaagctgatgtccggcaaggacgtgttctacctgcccccggagaagtgcgacaccctgctctgcgacatcggcgagagctcccccagccccaccgtcgaggagtcccggaccatccgcgtgctgaagatggtggagccctggctgaagaacaaccagttctgcatcaaggtcctcaacccgtacatgcccacggtgatcgagcacctggagcgcctgcagcggaagcacgggggcatgctcgtgcgcaaccccctgagccggaactccacccacgagatgtactggatcagcaacgggaccggcaacatcgtcgcctccgtgaacatggtgagccgcctgctcctgaaccggttcaccatgacgcaccgccggcccaccatcgagaaggacgtcgacctgggcgcggggacccgccacgtgaacgccgagccggagacccccaacatggacgtgatcggcgagcggatcaagcgcatcaaggaggagcacaactccacgtggcactacgacgacgagaacccctacaagacctgggcctaccacgggagctacgaggtcaaggccaccggctccgccagctccatgatcaacggggtggtcaagctcctgaccaagccgtgggacgtggtgcccatggtcacgcagatggcgatgaccgacaccacccccttcggccagcagcgggtgttcaaggagaaggtggacacgcgcacgccccggagcatgccgggcacccgccgggtcatggggatcaccgccgagtggctgtggcgcaccctcggccggaacaagaagccccgcctgtgcacccgggaggagttcaccaagaaggtgcgcaccaacgccgccatgggggcggtgttcacggaggagaaccagtgggacagcgccaaggccgccgtcgaggacgaggacttctggaagctggtggaccgcgagcgggagctccacaagctgggcaagtgcgggtcctgcgtgtacaacatgatgggcaagcgcgagaagaagctgggcgagttcgggaaggccaagggcagccgggcgatctggtacatgtggctcggggcccgctacctggagttcgaggccctgggcttcctcaacgaggaccactggttctcccgggagaacagctactccggggtcgagggcgagggcctgcacaagctggggtacatcctccgcgacatcagcaagatccccggcggggccatgtacgccgacgacaccgcgggctgggacacccggatcaccgaggacgacctgcacaacgaggagaagatcacgcagcagatggaccccgagcaccgccagctggccaacgccatcttcaagctcacctaccagaacaaggtggtgaaggtccagcggccgacccccaccggcaccgtgatggacatcatctcccgcaaggaccagcgggggagcggccaggtggggacgtacggcctgaacaccttcaccaacatgggggcccagctgatccgccagatggagggcgagggcgtcctctccaaggccgacctggagaacccccacctccccgagaagaagatcacccagtggctcgagacgaagggggtggagcggctgaagcgcatggcgatcagcggcgacgactgcgtggtcaagccgatcgacgaccggttcgccaacgccctgctcgccctgaacgacatggggaaggtgcgcaaggacatcccccagtggcagccctccaagggctggcacgactggcagcaggtccccttctgcagccaccacttccacgagctgatcatgaaggacgggcggaagctcgtcgtgccgtgccgcccccaggacgagctgatcggccgggcccgcatctcccagggcgcggggtggagcctgaaggagaccgcctgcctcggcaaggcctacgcccagatgtggtccctgatgtacttccaccggcgcgacctgcgcctcgcgagcaacgccatctgctccgccgtgcccgtccactgggtgcccaccagccggaccacgtggtccatccacgcccaccaccagtggatgaccaccgaggacatgctgaccgtgtggaaccgcgtctggatcgaggacaacccgtggatggaggacaagacgcccgtgaccacctgggagaacgtgccctacctggggaagcgggaggaccagtggtgcggcagcctcatcgggctgaccagccgcgccacgtgggcgcagaacatccccaccgccatccagcaggtccggtccctgatcggcaacgaggagttcctcgactacatgccgagcatgaagcgcttccggaaggaggaggagtccgagggcgccatctggtga

SEQ ID NO: 10045 - RNA, 9873 nt, synthetic construct
  misc_feature 1..9873: note = derived and/or modified CDS sequence (opt1) from DENV-3__JF920404__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacgcgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcgggctcaaggacaccctgaagcgccgcagctggcccctgaacgagggcgtcatggccgtgggcctcgtgtccatcctggcgagctccctgctccggaacgacgtccccatggccgggcccctggtggccggcgggctgctcatcgcctgctacgtgatcacgggcaccagcgccgacctgaccgtcgagaaggcggccgacatcacctgggaggagggggccgagcagacgggcgtgtcccacaacctgatgatcaccgtggacgacgacggcaccatgcgcatcaaggacgacgagaccgagaacatcctcaccgtcctgctgaagacggccctcctgatcgtgagcgggatcttcccgtactccatccccgccaccctgctcgtgtggcacacctggcagaagcagacccagcggagcggcgtcctgtgggacgtgcccagcccgcccgagacgcagaaggcggagctggaggagggggtgtaccgcatcaagcagcagggcatcttcgggaagacccaggtcggcgtgggcgtgcagaaggagggggtcttccacaccatgtggcacgtgacccggggcgccgtgctcacgtacaacgggaagcgcctggagcccaactgggccagcgtcaagaaggacctgatctcctacggcgggggctggcggctcagcgcccagtggcagaagggcgaggaggtccaggtgatcgcggtcgagcccgggaagaaccccaagaacttccagaccatgcccggcaccttccagaccacgaccggggagatcggcgccatcgccctggacttcaagcccggcacctccgggagccccatcatcaaccgcgagggcaaggtggtggggctgtacggcaacggggtcgtgaccaagaacggcggctacgtgagcgggatcgcccagacgaacgccgagccggacggccccacccccgagctggaggaggagatgttcaagaagcggaacctcaccatcatggacctgcaccccgggtccggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccaccaagtccgagcacaccggccgggagatcgtcgacctgatgtgccacgccaccttcaccatgcgcctcctgtcccccgtgcgggtgccgaactacaacctgatcatcatggacgaggcccacttcacggaccccgccagcatcgcggcccgcggctacatctccacccgggtcgggatgggcgaggccgccgcgatcttcatgaccgccacgccgcccgggacggccgacgccttcccgcagagcaacgcccccatccaggacgaggagcgcgacatccccgagcgctcctggaacagcggcaacgagtggatcaccgacttcgcggggaagaccgtgtggttcgtgccctccatcaaggccggcaacgacatcgccaactgcctccggaagaacggcaagaaggtcatccagctgagccgcaagaccttcgacacggagtaccagaagaccaagctgaacgactgggacttcgtggtgaccaccgacatctccgagatgggggccaacttcaaggccgaccgggtcatcgacccgcgccggtgcctcaagcccgtgatcctgacggacggccccgagcgcgtgatcctggcggggcccatgccggtcaccgccgccagcgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgagggcatcatcccggccctcttcgagcccgagcgggagaagtccgccgcgatcgacggggagtaccgcctgaagggcgagagccggaagacgttcgtggagctgatgcgccgcggggacctccccgtctggctggcccacaaggtggcctccgagggcatcaagtacaccgaccgcaagtggtgcttcgacggccagcggaacaaccagatcctggaggagaacatggacgtcgagatctggaccaaggagggggagaagaagaagctccgcccccggtggctggacgcccgcacctacagcgacccgctggccctcaaggagttcaaggagttcgcggccggccgcaagtccatcgccctggacctggtgacggagatcgggcgggtgcccagccacctcgcccaccgcacccggaacgccctggacaacctggtcatgctccacacctccgagcacggcgggcgcgcgtaccggcacgccgtggaggagctgcccgagaccatggagacgctgctcctgctgggcctcatgatcctgctgaccggcggggccatgctgttcctgatcagcggcaaggggatcggcaagaccagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcggcatcctcacgctggccgccatcatcgcggccaacgagatggggctgctcgagaccaccaagcgggacctgggcatgagcaaggagccgggggtggtgtcccccaccagctacctggacgtcgacctccaccccgcctccgcctggacgctgtacgcggtggccaccaccgtgatcacccccatgctgcgccacacgatcgagaacagcaccgccaacgtctccctcgccgccatcgcgaaccaggccgtggtgctgatgggcctggacaaggggtggccgatcagcaagatggacctcggcgtccccctgctggccctcggctgctactcccaggtgaaccccctgaccctgaccgccgccgtgctcctgctgatcacgcactacgcgatcatcgggcccggcctccaggccaaggccacccgggaggcccagaagcgcaccgccgcggggatcatgaagaacccgaccgtcgacggcatcatgacgatcgacctggaccccgtgatctacgacagcaagttcgagaagcagctgggccaggtgatgctcctggtcctgtgcgccgtgcagctcctgctgatgcggacctcctgggccctctgcgaggccctgaccctggcgaccgggcccatcacgaccctctgggagggcagccccgggaagttctggaacaccaccatcgccgtgtccatggccaacatcttccgcggcagctacctggccggggccggcctggcgttctccatcatgaagtccgtcggcacggggaagcggggcaccgggtcccagggcgagaccctcggggagaagtggaagaagaagctgaaccagctgagccgcaaggacttcgacctctacaagaagtccggcatcaccgaggtggaccggaccgaggccaaggagggcctgaagcgcggggagatcacgcaccacgccgtgtcccggggcagcgccaagctgcagtggttcgtcgagcgcaacatggtgatcccggaggggcgggtgatcgacctcggctgcgggcgcggcggctggtcctactactgcgccgggctgaagaaggtcaccgaggtgcggggctacaccaagggcgggcccgggcacgaggagcccgtgcccatgagcacctacggctggaacatcgtcaagctgatgtccggcaaggacgtgttctacctcccgcccgagaagtgcgacacgctgctgtgcgacatcggggagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacgcacgagatgtactggatcagcaacggcaccggcaacatcgtggcgtccgtcaacatggtgagccggctcctgctgaaccgcttcaccatgacccaccggcgcccgacgatcgagaaggacgtggacctcggggccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtgaaggccaccgggtccgcgagctccatgatcaacggcgtcgtgaagctgctgaccaagccctgggacgtcgtgcccatggtgacccagatggccatgacggacaccacccccttcggccagcagcgcgtcttcaaggagaaggtggacacccggacgccgcgcagcatgcccgggacccggcgcgtgatgggcatcaccgccgagtggctctggcggaccctggggcgcaacaagaagccccggctgtgcacgcgcgaggagttcaccaagaaggtccgcaccaacgccgcgatgggcgccgtgttcaccgaggagaaccagtgggacagcgccaaggccgccgtggaggacgaggacttctggaagctcgtcgaccgggagcgcgagctgcacaagctggggaagtgcggctcctgcgtgtacaacatgatgggcaagcgggagaagaagctcggggagttcggcaaggcgaaggggagccgcgccatctggtacatgtggctgggcgcccggtacctggagttcgaggccctcgggttcctgaacgaggaccactggttctcccgcgagaacagctactccggcgtggagggcgaggggctgcacaagctcggctacatcctgcgggacatcagcaagatccccgggggcgccatgtacgcggacgacacggccggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccgggaccgtcatggacatcatctcccggaaggaccagcgcggcagcggccaggtgggcacctacgggctgaacacgttcaccaacatggaggcccagctcatccggcagatggagggcgagggcgtgctgtccaaggcggacctggagaacccccacctcccggagaagaagatcacccagtggctggagaccaagggggtcgagcgcctgaagcggatggccatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcgcggatctcccagggcgccgggtggagcctcaaggagacggcctgcctgggcaaggcctacgcgcagatgtggtccctgatgtacttccaccgccgcgacctccggctggccagcaacgccatctgctccgccgtgcccgtgcactgggtcccgaccagccgcaccacctggtccatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgaccagccgggcgacctgggcccagaacatcccgacggccatccagcaggtccgctccctcatcggcaacgaggagttcctggactacatgcccagcatgaagcggttccgcaaggaggaggagtccgagggcgccatctggtga

SEQ ID NO: 10046 - RNA, 9873 nt, synthetic construct
  misc_feature 1..9873: note = derived and/or modified CDS sequence (opt1) from DENV-3__JF937641__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacgcgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcgggctcaaggacaccctgaagcgccgcagctggcccctgaacgagggcgtcatggccgtgggcctcgtgtccatcctggcgagctccctgctccggaacgacgtccccatggccgggcccctggtggccggcgggctgctcatcgcctgctacgtgatcacgggcaccagcgccgacctgaccgtcgagaaggcggccgacatcacctgggaggaggaggccgagcagacgggggtgtcccacaacctgatgatcaccgtggacgacgacggcaccatgcgcatcaaggacgacgagaccgagaacatcctcaccgtcctgctgaagacggccctcctgatcgtgagcggcatcttcccgtactccatccccgccaccctgctcgtgtggcacacctggcagaagcagacccagcggagcggggtcctgtgggacgtgcccagcccgcccgagacgcagaaggcggagctggaggagggcgtgtaccgcatcaagcagcaggggatcttcggcaagacccaggtcggggtgggcgtgcagaaggagggcgtcttccacaccatgtggcacgtgacccgcggggccgtgctcacgtacaacggcaagcgcctggagcccaactgggccagcgtcaagaaggacctgatctcctacgggggcgggtggcggctcagcgcccagtggcagaagggcgaggaggtccaggtgatcgcggtcgagcccggcaagaaccccaagaacttccagaccatgcccgggaccttccagaccacgaccggcgagatcggggccatcgccctggacttcaagcccggcacctccggcagccccatcatcaaccgcgaggggaaggtggtgggcctgtacgggaacggcgtcgtgaccaagaacgggggctacgtgagcggcatcgcccagacgaacgccgagccggacgggcccacccccgagctggaggaggagatgttcaagaagcggaacctcaccatcatggacctgcaccccggctccgggaagacccgcaagtacctgccggcgatcgtccgggaggccatcaagcgccggctccgcacgctgatcctggcccccacccgggtggtggccgccgagatggaggaggcgctcaagggcctgcccatccgctaccagaccaccgccaccaagtccgagcacaccgggcgggagatcgtcgacctgatgtgccacgccaccttcaccatgcgcctcctgtcccccgtgcgggtgccgaactacaacctgatcatcatggacgaggcccacttcacggaccccgccagcatcgcggcccgcggctacatctccacccgggtcggcatgggggaggccgccgcgatcttcatgaccgccacgccgcccggcacggccgacgccttcccgcagagcaacgcccccatccaggacgaggagcgcgacatccccgagcgctcctggaacagcgggaacgagtggatcaccgacttcgcgggcaagaccgtgtggttcgtgccctccatcaaggccgggaacgacatcgccaactgcctccggaagaacggcaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacgggcccgagcgcgtgatcctggcgggccccatgccggtcaccgccgccagcgccgcccagcggcgcgggcgggtgggccgcaacccccagaaggagaacgaccagtacatcttcaccgggcagcccctcaacaacgacgaggaccacgcgcactggaccgaggccaagatgctgctggacaacatcaacacccccgagggcatcatcccggccctcttcgagcccgagcgggagaagtccgccgcgatcgacggcgagtaccgcctgaagggggagagccggaagacgttcgtggagctgatgcgccggggcgacctccccgtctggctggcccacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacctacagcgacccgctggccctcaaggagttcaaggagttcgcggccgggcgcaagtccatcgccctggacctggtgacggagatcggccgggtgcccagccacctcgcccaccgcacccggaacgccctggacaacctggtcatgctccacacctccgagcacgggggccgcgcgtaccggcacgccgtggaggagctgcccgagaccatggagacgctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcggcatcctcacgctggccgccatcatcgcggccaacgagatgggcctgctcgagaccaccaagcgggacctggggatgagcaaggagccgggcgtggtgtcccccaccagctacctggacgtcgacctccaccccgcctccgcctggacgctgtacgcggtggccaccaccgtgatcacccccatgctgcgccacacgatcgagaacagcaccgccaacgtctccctcgccgccatcgcgaaccaggccgtggtgctgatggggctggacaagggctggccgatcagcaagatggacctcggggtccccctgctggccctcggctgctactcccaggtgaaccccctgaccctgaccgccgccgtgctcctgctgatcacgcactacgcgatcatcggccccgggctccaggccaaggccacccgggaggcccagaagcgcaccgccgcgggcatcatgaagaacccgaccgtcgacgggatcatgacgatcgacctggaccccgtgatctacgacagcaagttcgagaagcagctgggccaggtgatgctcctggtcctgtgcgccgtgcagctcctgctgatgcggacctcctgggccctctgcgaggccctgaccctggcgaccggccccatcacgaccctctgggaggggagccccggcaagttctggaacaccaccatcgccgtgtccatggccaacatcttccgcgggagctacctggccggcgccgggctggcgttctccatcatgaagtccgtcggcacgggcaagcgggggaccggctcccagggggagaccctcggcgagaagtggaagaagaagctgaaccagctgagccgcaaggacttcgacctctacaagaagtccgggatcaccgaggtggaccggaccgaggccaaggagggcctgaagcgcggcgagatcacgcaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacgcacgagatgtactggatcagcaacgggaccggcaacatcgtggcgtccgtcaacatggtgagccggctcctgctgaaccgcttcaccatgacccaccggcgcccgacgatcgagaaggacgtggacctcggcgccgggacccggcacgtcaacgccgagcccgagacccccaacatggacgtgatcggcgagcgcatcaagcggatcaaggaggagcacaactccacctggcactacgacgacgagaacccgtacaagacgtgggcctaccacgggagctacgaggtgaaggccaccggctccgcgagctccatgatcaacggggtcgtgaagctgctgaccaagccctgggacgtcgtgcccatggtgacccagatggccatgacggacaccacccccttcggccagcagcgcgtcttcaaggagaaggtggacacccggacgccgcgcagcatgcccggcacccggcgcgtgatggggatcaccgccgagtggctctggcggaccctgggccgcaacaagaagccccggctgtgcacgcgcgaggagttcaccaagaaggtccgcaccaacgccgcgatgggggccgtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggcgaagggcagccgcgccatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgcggacgacacggccggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcgggagcggccaggtggggacctacggcctgaacacgttcaccaacatggaggcccagctcatccggcagatggagggggagggcgtgctgtccaaggcggacctggagaacccccacctcccggagaagaagatcacccagtggctggagaccaagggcgtcgagcgcctgaagcggatggccatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcgcggatctcccagggcgccggctggagcctcaaggagacggcctgcctggggaaggcctacgcgcagatgtggtccctgatgtacttccaccgccgcgacctccggctggccagcaacgccatctgctccgccgtgcccgtgcactgggtcccgaccagccgcaccacctggtccatccacgcccaccaccagtggatgacgaccgaggacatgctgaccgtgtggaaccgggtgtggatcgaggacaacccctggatggaggacaagacccccgtcacgacctgggagaacgtgccctacctcggcaagcgcgaggaccagtggtgcgggagcctgatcggcctgaccagccgggcgacctgggcccagaacatcccgacggccatccagcaggtccgctccctcatcgggaacgaggagttcctggactacatgcccagcatgaagcggttccgcaaggaggaggagtccgagggcgccatctggtga

SEQ ID NO: 10047 - RNA, 9873 nt, synthetic construct
  misc_feature 1..9873: note = derived and/or modified CDS sequence (opt1) from DENV-3__JF920396__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggccctcctgacctggatcggcctgaacagcaagaacacctccatgagcttctcctgcatcgccatcgggatcatcacgctctacctgggcgccgtcgtgcaggcggacatggggtgcgtggtcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatggccgtggccgccatgggcgtgccgcccctcccgctgttcatcttcagcctcaaggacacgctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcaccgggacctccgccgacctgaccgtcgagaaggcggccgacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggagttcgcggccggccgcaagagcatcgccctggacctggtgaccgagatcgggcgggtgccctcccacctcgcccaccgcacccggaacgccctggacaacctggtcatgctccacaccagcgagcacggcgggcgcgcgtaccggcacgccgtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcaccctggccgccatcatcgcggccaacgagatgggcctgctcgagaccaccaagcgggacctgggcatgtccaaggagccgggggtggtgagccccacgtcctacctggacgtcgacctccaccccgccagcgcctggaccctgtacgcggtggccaccaccgtgatcacgcccatgctgcgccacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgacggccgccgtgctcctgctgatcacccactacgcgatcatcggccccggcctccaggccaaggccacccgggaggcccagaagcgcaccgccgcggggatcatgaagaacccgacggtcgacggcatcatgaccatcgacctggaccccgtgatctacgactccaagttcgagaagcagctgggccaggtgatgctcctggtcctgtgcgccgtgcagctcctgctgatgcggaccagctgggccctctgcgaggccctgaccctggcgacgggccccatcaccaccctctgggagggctcccccgggaagttctggaacaccacgatcgccgtgagcatggccaacatcttccgcggctcctacctggccggggccggcctggcgttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggccaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggcgagcgtcaacatggtgtcccggctcctgctgaaccgcttcaccatgacgcaccggcgcccgaccatcgagaaggacgtggacctcggcgccggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcgtccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgcgatgggcgccgtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggcggacctggagaacccccacctcccggagaagaagatcacccagtggctggagacgaagggcgtcgagcgcctgaagcggatggccatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcgcggatcagccagggggccggctggtccctcaaggagaccgcctgcctgggcaaggcctacgcgcagatgtggagcctgatgtacttccaccgccgcgacctccggctggcctccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggcgacgtgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10048 - RNA, 9873 nt, synthetic construct
  misc_feature 1..9873: note = derived and/or modified CDS sequence (opt1) from DENV-3__JF920406__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacgcgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcgagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcgggctcaaggacaccctgaagcgccgcagctggcccctgaacgagggcgtcatggccgtgggcctcgtgtccatcctggcgagctccctgctccggaacgacgtccccatggccgggcccctggtggccggcgggctgctcatcgcctgctacgtgatcacgggcaccagcgccgacctgaccgtcgagaaggcggccgacatcacctgggaggaggaggccgagcagacgggggtgtcccacaacctgatgatcaccgtggacgacgacggcaccatgcgcatcaaggacgacgagaccgagaacatcctcaccgtcctgctgaagacggccctcctgatcgtgagcggcatcttcccgtactccatccccgccaccctgctcgtgtggcacacctggcagaagcagacccagcggagcggggtcctgtgggacgtgcccagcccgcccgagacgcagaaggcggagctggaggagggcgtgtaccgcatcaagcagcaggggatcttcggcaagacccaggtcggggtgggcgtgcagaaggagggcgtcttccacaccatgtggcacgtgacccgcggggccgtgctcacgtacaacggcaagcgcctggagcccaactgggccagcgtcaagaaggacctgatctcctacgggggcgggtggcggctcagcgcccagtggcagaagggcgaggaggtccaggtgatcgcggtcgagcccggcaagaaccccaagaacttccagaccatgcccgggaccttccagaccacgaccggcgagatcggggccatcgccctggacttcaagcccggcacctccggcagccccatcatcaaccgcgaggggaaggtggtgggcctgtacgggaacggcgtcgtgaccaagaacgggggctacgtgagcggcatcgcccagacgaacgccgagccggacgggcccacccccgagctggaggaggagatgttcaagaagcggaacctcaccatcatggacctgcaccccggctccgggaagacccgcaagtacctgccggcgatcgtccgggaggccatcaagcgccggctccgcacgctgatcctggcccccacccgggtggtggccgccgagatggaggaggcgctcaagggcctgcccatccgctaccagaccaccgccaccaagtccgagcacaccgggcgggagatcgtcgacctgatgtgccacgccaccttcaccatgcgcctcctgtcccccgtgcgggtgccgaactacaacctgatcatcatggacgaggcccacttcacggaccccgccagcatcgcggcccgcggctacatctccacccgggtcggcatgggggaggccgccgcgatcttcatgaccgccacgccgcccggcacggccgacgccttcccgcagagcaacgcccccatccaggacgaggagcgcgacatccccgagcgctcctggaacagcgggaacgagtggatcaccgacttcgcgggcaagaccgtgtggttcgtgccctccatcaaggccgggaacgacatcgccaactgcctccggaagaacggcaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacgggcccgagcgcgtgatcctggcgggccccatgccggtcaccgccgccagcgccgcccagcggcgcgggcgggtgggccgcaacccccagaaggagaacgaccagtacatcttcaccgggcagcccctcaacaacgacgaggaccacgcgcactggaccgaggccaagatgctgctggacaacatcaacacccccgagggcatcatcccggccctcttcgagcccgagcgggagaagtccgccgcgatcgacggcgagtaccgcctgaagggggagagccggaagacgttcgtggagctgatgcgccggggcgacctccccgtctggctggcccacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacctacagcgacccgctggccctcaaggagttcaaggagttcgcggccgggcgcaagtccatcgccctggacctggtgacggagatcggccgggtgcccagccacctcgcccaccgcacccggaacgccctggacaacctggtcatgctccacacctccgagcacgggggccgcgcgtaccggcacgccgtggaggagctgcccgagaccatggagacgctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcggcatcctcacgctggccgccatcatcgcggccaacgagatgggcctgctcgagaccaccaagcgggacctggggatgagcaaggagccgggcgtggtgtcccccaccagctacctggacgtcgacctccaccccgcctccgcctggacgctgtacgcggtggccaccaccgtgatcacccccatgctgcgccacacgatcgagaacagcaccgccaacgtctccctcgccgccatcgcgaaccaggccgtggtgctgatggggctggacaagggctggccgatcagcaagatggacctcggggtccccctgctggccctcggctgctactcccaggtgaaccccctgaccctgaccgccgccgtgctcctgctgatcacgcactacgcgatcatcggccccgggctccaggccaaggccacccgggaggcccagaagcgcaccgccgcgggcatcatgaagaacccgaccgtcgacgggatcatgacgatcgacctggaccccgtgatctacgacagcaagttcgagaagcagctgggccaggtgatgctcctggtcctgtgcgccgtgcagctcctgctgatgcggacctcctgggccctctgcgaggccctgaccctggcgaccggccccatcacgaccctctgggaggggagccccggcaagttctggaacaccaccatcgccgtgtccatggccaacatcttccgcgggagctacctggccggcgccgggctggcgttctccatcatgaagtccgtcggcacgggcaagcgggggaccggctcccagggggagaccctcggcgagaagtggaagaagaagctgaaccagctgagccgcaaggacttcgacctctacaagaagtccgggatcaccgaggtggaccggaccgaggccaaggagggcctgaagcgcggcgagatcacgcaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacgcacgagatgtactggatcagcaacgggaccggcaacatcgtggcgtccgtcaacatggtgagccggctcctgctgaaccgcttcaccatgacccaccggcgcccgacgatcgagaaggacgtggacctcggcgccgggacccggcacgtcaacgccgagcccgagacccccaacatggacgtgatcggcgagcgcatcaagcggatcaaggaggagcacaactccacctggcactacgacgacgagaacccgtacaagacgtgggcctaccacgggagctacgaggtgaaggccaccggctccgcgagctccatgatcaacggggtcgtgaagctgctgaccaagccctgggacgtcgtgcccatggtgacccagatggccatgacggacaccacccccttcggccagcagcgcgtcttcaaggagaaggtggacacccggacgccgcgcagcatgcccggcacccggcgcgtgatggggatcaccgccgagtggctctggcggaccctgggccgcaacaagaagccccggctgtgcacgcgcgaggagttcaccaagaaggtccgcaccaacgccgcgatgggggccgtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggcgaagggcagccgcgccatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgcggacgacacggccggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcgggagcggccaggtggggacctacggcctgaacacgttcaccaacatggaggcccagctcatccggcagatggagggggagggcgtgctgtccaaggcggacctggagaacccccacctcccggagaagaagatcacccagtggctggagaccaagggcgtcgagcgcctgaagcggatggccatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcgcggatctcccagggcgccggctggagcctcaaggagacggcctgcctggggaaggcctacgcgcagatgtggtccctgatgtacttccaccgccgcgacctccggctggccagcaacgccatctgctccgccgtgcccgtgcactgggtcccgaccagccgcaccacctggtccatccacgcccaccaccagtggatgacgaccgaggacatgctgaccgtgtggaaccgggtgtggatcgaggacaacccctggatggaggacaagacccccgtcacgacctgggagaacgtgccctacctcggcaagcgcgaggaccagtggtgcgggagcctgatcggcctgaccagccgggcgacctgggcccagaacatcccgacggccatccagcaggtccgctccctcatcgggaacgaggagttcctggactacatgcccagcatgaagcggttccgcaaggaggaggagtccgagggcgccatctggtga

SEQ ID NO: 10049 - RNA, 9873 nt, synthetic construct
  misc_feature 1..9873: note = derived and/or modified CDS sequence (opt1) from DENV-3__JF920409__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcgcccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccacgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggccttcttcatgttcgtgctgctcctgtccggccagatcacctggcgcgacatggcccacaccctgatcatgatcggcagcaacgcctccgaccggatggggatgggcgtcacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatcttcaccctgaccgtggcctggcgcaccgcgacgctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcaccgggacgtccgcggacctgaccgtggagaaggccgccgacatcacctgggaggaggaggccgagcagaccggcgtcagccacaacctgatgatcacggtggacgacgacgggaccatgcgcatcaaggacgacgagtccgagaacatcctcaccgtgctgctgaagaccgccctcctgatcgtcagcggcatcttcccgtactccatccccgcgaccctgctcgtgtggcacacgtggcagaagcagacccagcggagcggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacacgatgtggcacgtcacccggggcgccgtgctcacctacaacgggaagcgcctggagcccaactgggccagcgtgaagaaggacctgatctcctacggcgggggctggcggctcagcgcgcagtggcagaagggggaggaggtccaggtgatcgccgtggagcccggcaagaaccccaagaacttccagaccatgcccggcacgttccagaccaccaccggggagatcggcgccatcgccctggacttcaagcccgggacgagcggctcccccatcatcaaccgcgagggcaaggtcgtggggctgtacggcaacggggtggtcaccaagaacggcgggtacgtgagcggcatcgcccagaccaacgcggagccggacggccccacccccgagctggaggaggagatgttcaagaagcggaacctcacgatcatggacctgcaccccgggtccggcaagacccgcaagtacctgccggccatcgtgcgggaggccatcaagcgccggctccgcaccctgatcctggcccccacccgggtcgtggccgcggagatggaggaggccctcaaggggctgcccatccgctaccagacgaccgccaccaagagcgagcacaccggccgggagatcgtggacctgatgtgccacgccacgttcaccatgcgcctcctgtcccccgtccgggtgccgaactacaacctgatcatcatggacgaggcccacttcaccgaccccgcgagcatcgccgcccgcgggtacatctccacccgggtgggcatgggcgaggccgcggccatcttcatgacggccacgccgcccgggaccgccgacgccttcccgcagagcaacgcgcccatccaggacgaggagcgcgacatccccgagcgctcctggaacagcggcaacgagtggatcaccgacttcgccgggaagacggtctggttcgtgccctccatcaaggccggcaacgacatcgccaactgcctccggaagaacgggaagaaggtgatccagctgagccgcaagaccttcgacaccgagtaccagaagaccaagctgaacgactgggacttcgtcgtgacgaccgacatctccgagatgggcgccaacttcaaggcggaccgggtgatcgacccgcgccggtgcctcaagcccgtcatcctgaccgacggccccgagcgcgtgatcctggccgggcccatgccggtgaccgccgccagcgccgcgcagcggcgcggccgggtcgggcgcaacccccagaaggagaacgaccagtacatcttcacgggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagagccggaagaccttcgtggagctgatgcgccgcggggacctccccgtgtggctggcccacaaggtcgcctccgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctacagcgacccgctggcgctcaaggagttcaaggagttcgccgccggccgcaagtccatcgccctggacctggtcaccgagatcgggcgggtgcccagccacctcgcccaccgcacccggaacgcgctggacaacctggtgatgctccacacgagcgagcacggcgggcgcgcctaccggcacgccgtcgaggagctgcccgagaccatggagaccctgctcctgctgggcctcatgatcctgctgaccgggggcgccatgctgttcctgatctccggcaaggggatcggcaagacgagcatcgggctgatctgcgtgatcgcctccagcggcatgctctggatggcggagatcccgctgcagtggatcgcctccgccatcgtgctggagttcttcatgatggtcctcctgatccccgagcccgagaagcagcgcacgccccaggacaaccagctggcctacgtggtgatcgggatcctcaccctggccgcgatcatcgccgccaacgagatgggcctgctcgagaccacgaagcgggacctgggcatgagcaaggagccgggggtcgtgtcccccaccagctacctggacgtggacctccaccccgcctccgcgtggaccctgtacgccgtcgccaccacggtgatcacccccatgctgcgccacaccatcgagaacagcaccgccaacgtgtccctcgccgcgatcgccaaccaggccgtcgtgctgatgggcctggacaaggggtggccgatcagcaagatggacctcggcgtgcccctgctggccctcgggtgctactcccaggtcaaccccctgacgctgaccgccgcggtgctcctgctgatcacccactacgccatcatcggccccggcctccaggccaaggccacccgggaggcccagaagcgcacggcggccgggatcatgaagaacccgaccgtggacggcatcatgaccatcgacctggaccccgtcatctacgacagcaagttcgagaagcagctgggccaggtgatgctcctggtgctgtgcgccgtccagctcctgctgatgcggacctcctgggccctctgcgaggcgctgacgctggccaccggccccatcaccaccctctgggagggcagccccgggaagttctggaacacgaccatcgccgtgtccatggccaacatcttccgcggcagctacctggccggggcgggcctggccttctccatcatgaagtccgtggggaccggcaagcggggcaccgggagccagggcgagacgctcggggagaagtggaagaagaagctgaaccagctgtcccgcaaggacttcgacctctacaagaagtccggcatcaccgaggtcgaccggaccgaggccaaggaggggctgaagcgcggcgagatcacccaccacgccgtgtcccggggcagcgccaagctgcagtggttcgtggagcgcaacatggtcatcccggaggggcgggtgatcgacctcggctgcgggcgcggcgggtggtcctactactgcgcgggcctgaagaaggtgaccgaggtccggggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccgcacgatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacccacgagatgtactggatcagcaacggcaccgggaacatcgtggcctccgtgaacatggtcagccggctcctgctgaaccgcttcacgatgacccaccggcgcccgaccatcgagaaggacgtggacctcggcgccggcacccggcacgtgaacgccgagcccgagacgcccaacatggacgtcatcggggagcgcatcaagcggatcaaggaggagcacaactccacctggcactacgacgacgagaacccgtacaagacctgggcctaccacggcagctacgaggtgaaggcgaccgggtccgccagcagcatgatcaacggcgtggtcaagctgctgacgaagccctgggacgtggtccccatggtgacccagatggccatgaccgacaccacgcccttcgggcagcagcgcgtgttcaaggagaaggtcgacacccggaccccgcgctccatgcccggcacccggcgcgtgatgggcatcacggccgagtggctctggcggaccctggggcgcaacaagaagccccggctgtgcacccgcgaggagttcaccaagaaggtgcgcacgaacgcggccatgggcgccgtcttcaccgaggagaaccagtgggacagcgccaaggccgcggtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgcgatgtacgccgacgacaccgccgggtgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccacgggcaccgtgatggacatcatctcccggaaggaccagcgcggcagcgggcaggtcggcacctacgggctgaacaccttcaccaacatggaggcgcagctcatccggcagatggagggcgagggggtgctgtccaaggccgacctggagaacccccacctcccggagaagaagatcacgcagtggctggagaccaagggcgtggagcgcctgaagcggatggccatcagcggcgacgactgcgtcgtgaagcccatcgacgaccgcttcgccaacgccctcctggcgctgaacgacatggggaaggtgcggaaggacatcccccagtggcagccctccaagggctggcacgactggcagcaggtcccgttctgcagccaccacttccacgagctcatcatgaaggacgggcgcaagctggtggtgccctgccggccccaggacgagctgatcggccgcgcccggatctcccagggggccggctggagcctcaaggagaccgcctgcctgggcaaggcgtacgcccagatgtggtccctgatgtacttccaccgccgcgacctccggctggccagcaacgccatctgctccgccgtccccgtgcactgggtgccgaccagccgcacgacctggagcatccacgcgcaccaccagtggatgaccaccgaggacatgctgacggtctggaaccgggtgtggatcgaggacaacccctggatggaggacaagacccccgtgaccacctgggagaacgtcccctacctcgggaagcgcgaggaccagtggtgcggctccctgatcgggctgacgagccgggccacctgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 10050 - RNA, 9873 nt, synthetic construct
  misc_feature 1..9873: note = derived and/or modified CDS sequence (opt1) from DENV-3__JF920408__SS-prME
  source 1..9873: mol_type = other RNA
accagcctctgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgggacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgggacccagggcgtgacggccgagatcacgccccaggccagcaccaccgaggcgatcctgcccgagtacgggaccctgggcctcgagtgctccccgcgcacgggcctggacttcaacgagatgatcctgctcaccatgaagaacaaggcctggatggtccaccggcagtggttcttcgacctgcccctgccctggaccagcggggccaccacggagacccccacctggaaccgcaaggagctcctggtgaccttcaagaacgcccacgccaagaagcaggaggtggtcgtgctgggctcccaggagggggcgatgcacacggccctcaccggcgccaccgagatccagaacagcgggggcaccggcatcttcgccgggcacctgaagtgccggctgaagatggacaagctcgagctgaagggcatgtcctacgccatgtgcacgaacaccttcgtgctgaagaaggaggtcagcgagacccagcacgggaccatcctcatcaaggtggagtacaagggcgaggacgtgccgtgcaagatccccttctccacggaggacggccaggggaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagctccatcggcaagatgttcgaggcgaccgcccgcggggcccgccggatggccatcctgggcgacacggcctgggacttcgggagcgtgggcggggtgctcaactccctgggcaagatggtccaccagatcttcggcagcgcgtacaccgccctgttctccggggtgagctgggtgatgaagatcggcatcggggtcctcctgacctggatcggcctgaactccaagaacaccagcatgtccttcagctgcatcgccatcgggatcatcacgctctacctgggcgccgtggtgcaggccgacatgggctgcgtcatcaactggaaggggaaggagctgaagtgcggctccgggatcttcgtgaccaacgaggtgcacacctggaccgagcagtacaagttccaggcggacagccccaagcgcctcgccacggccatcgccggcgcctgggagaacggggtctgcggcatccgctccaccacccggatggagaacctgctgtggaagcagatcgcgaacgagctcaactacatcctgtgggagaacaacatcaagctgaccgtggtggtcggcgacatcatcggggtgctcgagcagggcaagcgcacgctgacgccccagccgatggagctgaagtacagctggaagacctgggggaaggccaagatcgtgaccgccgagacgcagaactccagcttcatcatcgacggccccaacacccccgagtgcccctccgtcagccgggcctggaacgtgtgggaggtggaggactacggcttcggggtcttcaccaccaacatctggctcaagctgcgcgaggtgtacacccagctgtgcgaccaccggctcatgtccgcggccgtgaaggacgagcgcgccgtccacgccgacatgggctactggatcgagagccagaagaacgggagctggaagctggagaaggcctccctgatcgaggtgaagacgtgcacctggcccaagagccacaccctctggtccaacggcgtgctggagagcgacatgatcatccccaagtccctggcggggcccatcagccagcacaaccaccggccgggctaccacacccagacggccggcccctggcacctcgggaagctggagctggacttcaactactgcgagggcaccaccgtcgtgatcaccgagaactgcgggacgcgcggcccctccctccggaccaccaccgtgagcgggaagctgatccacgagtggtgctgccgctcctgcacgctgcccccgctccggtacatgggcgaggacggctgctggtacgggatggagatccgccccatcagcgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggcgtgttcttcaccttcgtcctgctcctgagcgggcagatcacctggcgcgacatggcgcacacgctgatcatgatcggctccaacgccagcgaccggatggggatgggcgtgacctacctcgccctgatcgccaccttcaagatccagcccttcctggccctcggcttcttcctgcgcaagctgacctcccgggagaacctcctgctgggggtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgcagcaacaccatcttcaccctgacggtcgcctggcgcaccgccaccctgatcctcgccggggtgtccctgctgccggtctgccagagctccagcatgcggaagaccgactggctccccatggcggtggccgccatgggcgtgccgcccctcccgctgttcatcttcggcctcaaggacacgctgaagcgccgctcctggcccctgaacgagggggtcatggccgtgggcctcgtgagcatcctggcctccagcctgctccggaacgacgtccccatggcggggcccctggtggccggcgggctgctcatcgcctgctacgtgatcaccggcacctccgccgacctgaccgtcgagaaggccgcggacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggggtcctgtgggacgtgcccagcccgcccgagacccagaaggccgagctggaggagggcgtgtaccgcatcaagcagcaggggatcttcggcaagacccaggtcggcgtgggggtgcagaaggagggcgtcttccacaccatgtggcacgtgacgcgcggggcggtgctcacctacaacggcaagcgcctggagcccaactgggcctccgtcaagaaggacctgatcagctacgggggcggctggcggctctccgcccagtggcagaagggggaggaggtccaggtgatcgccgtcgagcccggcaagaaccccaagaacttccagaccatgcccgggaccttccagacgaccaccggcgagatcggcgcgatcgccctggacttcaagcccgggaccagcggctcccccatcatcaaccgcgaggggaaggtggtgggcctgtacgggaacggcgtcgtgacgaagaacggcgggtacgtgagcggcatcgcccagaccaacgccgagccggacgggcccacccccgagctggaggaggagatgttcaagaagcggaacctcaccatcatggacctgcaccccggcagcgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggggaggccgccgccatcttcatgaccgcgacgccgcccggcaccgccgacgccttcccgcagtccaacgcccccatccaggacgaggagcgcgacatccccgagcgcagctggaactccgggaacgagtggatcaccgacttcgccggcaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacgggcccgagcgcgtgatcctggccggccccatgccggtcaccgcggcctccgccgcccagcggcgcgggcgggtgggccgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggggagtcccggaagaccttcgtggagctgatgcgccggggcgacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggagttcgccgcggggcgcaagagcatcgccctggacctggtgaccgagatcggccgggtgccctcccacctcgcccaccgcacccggaacgccctggacaacctggtcatgctccacaccagcgagcacgggggccgcgcctaccggcacgcggtggaggagctgcccgagacgatggagaccctgctcctgctgggcctcatgatcctgctgaccgggggcgccatgctgttcctgatctccgggaagggcatcgggaagaccagcatcggcctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctggggatgtccaaggagccgggcgtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatggggctggacaagggctggccgatctccaagatggacctcggcgtccccctgctggccctcgggtgctacagccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggaggggtcccccggcaagttctggaacaccacgatcgcggtgagcatggccaacatcttccgcgggtcctacctggccggcgccggcctggccttcagcatcatgaagtccgtcgggaccggcaagcgggggaccggcagccagggggagaccctcggcgagaagtggaagaagaagctgaaccagctgtcccgcaaggacttcgacctctacaagaagtccggcatcaccgaggtggaccggacggaggcgaaggaggggctgaagcgcggcgagatcacccaccacgccgtgagccgggggtccgccaagctgcagtggttcgtcgagcgcaacatggtgatcccggagggccgggtgatcgacctcgggtgcggccgcggcgggtggagctactactgcgccggcctgaagaaggtcaccgaggtgcgggggtacaccaagggcgggcccggccacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcggggacccggcacgtcaacgccgagcccgagacccccaacatggaggtgatcggcgagcgcatcaagcggatcaaggaggagcacaacagcacgtggcactacgacgacgagaacccgtacaagacctgggcctaccacgggtcctacgaggtgaaggccaccggcagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgctccatgcccggcacccggcgcgtgatggggatcaccgccgagtggctctggcggacgctgggccgcaacaagaagccccggctgtgcacccgcgaggagttcaccaagaaggtccgcaccaacgccgccatgggggcggtgttcacggaggagaaccagtgggacagcgccaaggccgccgtggaggacgaggacttctggaagctcgtcgaccgggagcgcgagctgcacaagctgggcaagtgcggcagctgcgtgtacaacatgatggggaagcgggagaagaagctcggcgagttcgggaaggccaagggctcccgcgcgatctggtacatgtggctgggggcccggtacctggagttcgaggccctcggcttcctgaacgaggaccactggttcagccgcgagaactcctacagcggcgtggagggggagggcctgcacaagctcgggtacatcctgcgggacatctccaagatccccggcggcgccatgtacgccgacgacaccgcggggtgggacacccgcatcaccgaggacgacctgcacaacgaggagaagatcacgcagcagatggacccggagcaccggcagctcgccgacgccatcttcaagctgacctaccagaacaaggtcgtgaaggtgcagcgccccacccccaccggcaccgtcatggacatcatcagccggaaggaccagcgcgggtccggccaggtggggacgtacggcctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggggacgactgcgtggtgaagcccatcgacgaccgcttcgccaacgccctcctggccctgaacgacatgggcaaggtccggaaggacatcccccagtggcagcccagcaaggggtggcacgactggcagcaggtcccgttctgctcccaccacttccacgagctcatcatgaaggacggccgcaagctggtggtcccctgccggccccaggacgagctgatcggccgcgcccggatcagccagggggcgggctggtccctcaaggagaccgcctgcctggggaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggtccctgatcggcctgaccagccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10051 - RNA, 9873 nt, synthetic construct
  misc_feature 1..9873: note = derived and/or modified CDS sequence (opt1) from DENV-3__JF920397__SS-prME
  source 1..9873: mol_type = other RNA
accagcctgtgcctcatgatgatcctgcccgcggccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggacctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcgcacggccaccctgatcctcgccggggtgagcctgctgccgatgtgccagtccagctccatgcggaagaccgactggctccccatggcggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggcctccgtgaagaaggacctgatcagctacggcgggggctggcggctctccacccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtctggttcgtgcccagcatcaaggccggcaacgacatcgcgaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgccgcgtccgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtgtggctggcccacaaggtcgcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggagttcgccgccggccgcaagagcatcgcgctggacctggtcaccgagatcgggcgggtgccctcccacctcgcccaccgcacccggaacgccctggacaacctggtgatgctccacaccagcgagcacggcgggcgcgcctaccggcacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcgcacgccccaggacaaccagctggcgtacgtggtgatcgggatcctcaccctggccgccatcatcgccgccaacgagatgggcctgctcgagaccaccaagcgggacctgggcatgtccaaggagccgggggtcgtgagccccacgtcctacctggacgtggacctccaccccgcgagcgcctggaccctgtacgccgtcgccaccaccgtgatcacgcccatgctgcgccacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgggaggcccagaagcgcaccgccgccgggatcatgaagaacccgacggtggacggcatcatgaccatcgacctggaccccgtcatctacgactccaagttcgagaagcagctgggccaggtgatgctcctggtgctgtgcgtcgtgcagctcctgctgatgcggaccagctgggccctctgcgaggcgctgaccctggccacgggccccatcaccaccctctgggagggctcccccgggaagttctggaacaccacgatcgccgtgagcatggccaacatcttccgcggctcctacctggcgggggccggcctggccttcagcatcatgaagtccgtcgggaccggcaagcggggcaccgggagccagggcgagaccctcggggagaagtggaagaagaagctgaaccagctgagccgcaaggacttcgacctctacaagaagtccggcatcaccgaggtggaccggacggaggccaaggaggggctgaagcgcggcgagatcacccaccacgccgtgagccggggctccgcgaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgccggcacccggcacgtcaacgccgagcccgagacccccaacatggacgtgatcggggagcgcatcaagcggatcaaggaggagcacaacagcacgtggcactacgacgacgagaacccgtacaagacctgggcgtaccacggctcctacgaggtgaaggccaccgggagcgcctccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgcggccatgggcgccgtgttcacggaggagaaccagtgggactccgccaaggcggccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggcgctcgggttcctgaacgaggaccactggttcagccgcgagaactcctacagcggcgtggagggggagggcctgcacaagctcggctacatcctgcgggacatctccaagatccccgggggcgccatgtacgccgacgacaccgccgggtgggacacccgcatcaccgaggacgacctgcacaacgaggagaagatcacgcagcagatggacccggagcaccggcagctcgccaacgcgatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggccatctccggcgacgactgcgtggtgaagcccatcgacgaccgcttcgccaacgcgctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctcaaggagaccgcctgcctgggcaaggcgtacgcccagatgtggagcctgatgtacttccaccgccgcgacctccggctggcctccaacgccatctgcagcgcggtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcccagaacatcccgaccgccatccagcaggtccgcagcctcatcggcaacgaggagttcctggactacatgccctccatgaagcggttccgcaaggaggaggagagcgagggggcgatctggtga

SEQ ID NO: 10052 - RNA, 9873 nt, synthetic construct
  misc_feature 1..9873: note = derived and/or modified CDS sequence (opt1) from DENV-3__JN093513__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacacctccgaccggatggggatgggcgtgacctacctcgccctgatcgccaccttcaagatccagcccttcctggccctcgggttcttcctgcgcaagctgacgagccgggagaacctcctgctgggcgtgggcctcgccatggcgaccaccctgcagctgcccgaggacatcgagcagatggccaacgggatcgccctcggcctgatggccctgaagctcatcacccagttcgagatctaccagctgtggacggcgctgatcagcctgacctgctccaacaccatcttcaccctgacggtcgcctggcgcaccgccaccctgatcctcgccggggtgagcctgctgccggtctgccagtccagctccatgcggaagaccgactggctccccatggccgtggcggccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggccgggcccctggtggcgggcgggctgctcatcgcctgctacgtgatcaccggcaccagcgccgacctgaccgtcgagaaggccgccgacatcacgtgggaggaggaggcggagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggcgagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggccatcgcgctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggccatcaagcgccggctccgcaccctgatcctggcgcccacccgggtggtggccgccgagatggaggaggccctcaagggcctgcccatccgctaccagaccacggccaccaagagcgagcacaccgggcgggagatcgtcgacctgatgtgccacgcgaccttcacgatgcgcctcctgtcccccgtgcgggtgccgaactacaacctgatcatcatggacgaggcccacttcaccgaccccgccagcatcgccgcccgcggctacatctccacccgggtcggcatgggggaggcggccgccatcttcatgaccgccacgccgcccggcaccgcggacgccttcccgcagagcaacgcccccatccaggacgaggagcgcgacatccccgagcgctcctggaacagcgggaacgagtggatcaccgacttcgccggcaagaccgtgtggttcgtgccctccatcaaggccgggaacgacatcgcgaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgccgcgagcgccgcccagcggcgcgggcgggtgggccgcaacccccagaaggagaacgaccagtacatcttcaccgggcagcccctcaacaacgacgaggaccacgcccactggaccgaggccaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcccacaaggtggcgtccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgccgggcgcaagtccatcgcgctggacctggtgaccgagatcggccgggtgcccagccacctcgcccaccgcacccggaacgccctggacaacctggtcatgctccacacctccgagcacgggggccgcgcctaccggcacgccgtggaggagctgcccgagacgatggagaccctgctcctgctggggctcatgatcctgctgaccggcggcgcgatgctgttcctgatcagcgggaagggcatcgggaagaccagcatcggcctgatctgcgtgatcgcctccagcgggatgctctggatggccgagatcccgctgcagtggatcgcctccgccatcgtcctggagttcttcatgatggtgctcctgatccccgagcccgagaagcagcgcacgccccaggacaaccagctggcgtacgtggtcatcggcatcctcaccctggccgccatcatcgccgccaacgagatgggcctgctcgagaccaccaagcgggacctggggatgagcaaggagccgggcgtggtgtcccccacgagctacctggacgtcgacctccaccccgcgtccgcctggaccctgtacgccgtggccaccaccgtgatcacgcccatgctgcgccacaccatcgagaacagcaccgcgaacgtctccctcgccgccatcgccaaccaggccgtggtgctgatggggctggacaagggctggccgatcagcaagatggacctcggggtccccctgctggcgctcggctgctactcccaggtgaaccccctgaccctgacggccgccgtgctcctgctgatcacccactacgccatcatcggccccgggctccaggccaaggcgacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgccgtgcagctcctgctgatgcggacctcctgggcgctctgcgaggccctgaccctggccacgggccccatcaccaccctctgggaggggagccccggcaagttctggaacaccacgatcgccgtgtccatggcgaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggccaaggagggcctgaagcgcggcgagatcacccaccacgcggtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcaccatgacgcaccggcgcccgaccatcgagaaggacgtggacctcggcgccgggacccggcacgtcaacgcggagcccgagacccccaacatggacgtgatcggcgagcgcatcaagcggatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggccatgaccgacaccacccccttcggccagcagcgcgtcttcaaggagaaggtggacacgcggaccccgcgcagcatgcccggcacccggcgcgtgatggggatcaccgcggagtggctctggcggacgctgggccgcaacaagaagccccggctgtgcacccgcgaggagttcaccaagaaggtccgcaccaacgccgccatgggggccgtgttcacggaggagaaccagtgggacagcgcgaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgccatctggtacatgtggctgggggcgcggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgccggctgggacacccgcatcaccgaggacgacctgcacaacgaggagaagatcacgcagcagatggacccggagcaccggcagctcgcgaacgccatcttcaagctgacctaccagaacaaggtcgtgaaggtgcagcgccccacccccaccggcaccgtcatggacatcatctcccggaaggaccagcgcgggagcggccaggtggggacgtacggcctgaacaccttcaccaacatggaggcccagctcatccggcagatggagggggagggcgtgctgtccaaggccgacctggagaacccccacctcccggagaagaagatcacccagtggctggagacgaagggcgtcgagcgcctgaagcggatggccatcagcggggacgactgcgtggtgaagcccatcgacgaccgcttcgcgaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgccggctggagcctcaaggagaccgcgtgcctggggaaggcctacgcccagatgtggtccctgatgtacttccaccgccgcgacctccggctggccagcaacgcgatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgaccagccgggccacgtgggcccagaacatcccgaccgcgatccagcaggtccgctccctcatcgggaacgaggagttcctggactacatgcccagcatgaagcggttccgcaaggaggaggagtccgagggcgccatctggtga

SEQ ID NO: 10053 - RNA, 9873 nt, synthetic construct
  misc_feature 1..9873: note = derived and/or modified CDS sequence (opt1) from DENV-3__JF937624__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgatcaccggcgagatcggggcgatcgccctggacttcaagcccggcacctccggcagccccatcatcaaccgcgaggggaaggtggtgggcctgtacgggaacggcgtcgtgaccaagaacgggggctacgtgagcggcatcgcccagacgaacgccgagccggacgggcccacccccgagctggaggaggagatgttcaagaagcggaacctcaccatcatggacctgcaccccggctccgggaagacccgcaagtacctgccggccatcgtccgggaggcgatcaagcgccggctccgcacgctgatcctggcccccacccgggtggtggccgccgagatggaggaggccctcaagggcctgcccatccgctaccagaccaccgcgaccaagtccgagcacaccgggcgggagatcgtcgacctgatgtgccacgccaccttcaccatgcgcctcctgtcccccgtgcgggtgccgaactacaacctgatcatcatggacgaggcccacttcacggaccccgccagcatcgccgcgcgcggctacatctccacccgggtcggcatgggggaggccgccgccatcttcatgaccgcgacgccgcccggcacggccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacccccgagggcatcatcccggccctcttcgagcccgagcgggagaagtccgccgccatcgacggcgagtaccgcctgaagggggagagccggaagacgttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacctacagcgacccgctggccctcaaggagttcaaggagttcgccgcggggcgcaagtccatcgccctggacctggtgacggagatcggccgggtgcccagccacctcgcccaccgcacccggaacgccctggacaacctggtcatgctccacacctccgagcacgggggccgcgcctaccggcacgcggtggaggagctgcccgagaccatggagacgctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcacgctggccgccatcatcgccgcgaacgagatgggcctgctcgagaccaccaagcgggacctggggatgagcaaggagccgggcgtggtgtcccccaccagctacctggacgtcgacctccaccccgcctccgcctggacgctgtacgccgtggcgaccaccgtgatcacccccatgctgcgccacacgatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgaccgccgccgtgctcctgctgatcacgcactacgccatcatcggccccgggctccaggcgaaggccacccgggaggcccagaagcgcaccgccgccggcatcatgaagaacccgaccgtcgacgggatcatgacgatcgacctggaccccgtgatctacgacagcaagttcgagaagcagctgggccaggtgatgctcctggtcctgtgcgcggtgcagctcctgctgatgcggacctcctgggccctctgcgaggccctgaccctggccaccggccccatcacgaccctctgggaggggagccccggcaagttctggaacaccaccatcgcggtgtccatggccaacatcttccgcgggagctacctggccggcgccgggctggccttctccatcatgaagtccgtcggcacgggcaagcgggggaccggctcccagggggagaccctcggcgagaagtggaagaagaagctgaaccagctgagccgcaaggacttcgacctctacaagaagtccgggatcaccgaggtggaccggaccgaggcgaaggagggcctgaagcgcggcgagatcacgcaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacgcacgagatgtactggatcagcaacgggaccggcaacatcgtggcctccgtcaacatggtgagccggctcctgctgaaccgcttcaccatgacccaccggcgcccgacgatcgagaaggacgtggacctcggcgcggggacccggcacgtcaacgccgagcccgagacccccaacatggacgtgatcggcgagcgcatcaagcggatcaaggaggagcacaactccacctggcactacgacgacgagaacccgtacaagacgtgggcctaccacgggagctacgaggtgaaggccaccggctccgccagctccatgatcaacggggtcgtgaagctgctgaccaagccctgggacgtcgtgcccatggtgacccagatggcgatgacggacaccacccccttcggccagcagcgcgtcttcaaggagaaggtggacacccggacgccgcgcagcatgcccggcacccggcgcatcatggggatcaccgccgagtggctctggcggaccctgggccgcaacaagaagccccggctgtgcacgcgcgaggagttcaccaagaaggtgcgcaccaacgccgccatgggggcggtcttcaccgaggagaaccagtgggacagcgccaaggccgccgtggaggacgaggacttctggaagctcgtggaccgggagcgcgagctgcacaagctgggcaagtgcgggtcctgcgtctacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacacggcgggctgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatctcccggaaggaccagcgcgggagcggccaggtcgggacctacggcctgaacacgttcaccaacatggaggcccagctcatccggcagatggagggggagggcgtgctgtccaaggccgacctggagaacccccacctcccggagaagaagatcacccagtggctggagaccaagggcgtggagcgcctgaagcggatggcgatcagcggggacgactgcgtcgtgaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtggtgccctgccggccccaggacgagctgatcgggcgcgcccggatctcccagggcgcgggctggagcctcaaggagacggcctgcctggggaaggcctacgcccagatgtggtccctgatgtacttccaccgccgcgacctccggctggcgagcaacgccatctgctccgccgtccccgtgcactgggtgccgaccagccgcaccacctggtccatccacgcccaccaccagtggatgacgaccgaggacatgctgaccgtctggaaccgggtgtggatcgaggacaacccctggatggaggacaagacccccgtgacgacctgggagaacgtcccctacctcggcaagcgcgaggaccagtggtgcgggagcctgatcggcctgaccagccgggccacctgggcgcagaacatcccgacggccatccagcaggtccgctccctcatcgggaacgaggagttcctggactacatgcccagcatgaagcggttccgcaaggaggaggagtccgagggcgccatctggtga

SEQ ID NO: 10054 - RNA, 9873 nt, synthetic construct
  misc_feature 1..9873: note = derived and/or modified CDS sequence (opt1) from DENV-3__JN000938__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccttctccgagaaggaggagaacatggtcaagagcctggtgtccgccggcgggggcaaggtggacaacttcaccatgggggtcctgtgcctcgccatcctgttcgaggaggtgatgcggggcaagttcgggaagaagcacatgatcgccggcgtgttcttcaccttcgtcctgctcctgagcggccagatcacctggcgcgacatggcgcacacgctgatcatgatcgggtccaacgccagcgaccggatgggcatgggggtgacctacctcgccctgatcgccaccttcaagatccagcccttcctggccctcggcttcttcctgcgcaagctgacctcccgggagaacctcctgctgggcgtggggctcgcgatggccacgaccctgcagctgcccgaggacatcgagcagatggccaacggcatcgccctcgggctgatggcgctgaagctcatcacccagttcgagacctaccagctgtggacggccctgatcagcctgacctgcagcaacaccatcttcaccctgacggtcgcctggcgcaccgccaccctgatcctcgccggcgtgtccctgctgccggtctgccagagctccagcatgcggaagaccgactggctccccatggcggtggccgccatgggggtgccgcccctcccgctgttcatcttcggcctcaaggacacgctgaagcgccgctcctggcccctgaacgagggcgtcatggccgtggggctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacggcaccatgcgcatcaaggacgacgagaccgagaacatcctcacggtcctgctgaagaccgccctcctgatcgtgtccgggatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggcgtgcagaaggagggggtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggcgaggaggtccaggtgatcgccgtcgagcccgggaagaaccccaagaacttccagaccatgcccggcaccttccagacgaccaccggggagatcggcgcgatcgccctggacttcaagcccggcaccagcgggtcccccatcatcaaccgcgagggcaaggtggtggggctgtacggcaacggggtcgtgacgaagaacggcggctacgtgagcgggatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcggctacatcagcacccgggtcgggatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacggcaagaaggtcatccagctgtcccgcaagacgttcgacaccgagtaccagaagaccaagctgaacgactgggacttcgtggtgaccacggacatcagcgagatgggggccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgagggcatcatcccggccctcttcgagcccgagcgggagaagtccgccgccatcgacggggagtaccgcctgaagggcgagtcccggaagaccttcgtggagctgatgcgccgcggggacctccccgtctggctggcgcacaaggtggccagcgagggcatcaagtacaccgaccgcaagtggtgcttcgacggccagcggaacaaccagatcctggaggagaacatggacgtcgagatctggaccaaggagggggagaagaagaagctccgcccccggtggctggacgcccgcacgtactccgacccgctggccctcaaggagttcaaggagttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccggcggggccatgctgttcctgatctccggcaaggggatcggcaagaccagcatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatggggctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcggctgctacagccaggtgaaccccctgaccctgacggccgccgtgctcctgctgatcacccactacgccatcatcgggcccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacggggcccatcaccaccctctgggagggctcccccgggaagttctggaacaccacgatcgcggtgagcatggccaacatcttccgcggctcctacctggccggggccggcctggccttcagcatcatgaagtccgtcggcaccgggaagcggggcaccgggagccagggcgagaccctcggggagaagtggaagaagaagctgaaccagctgtcccgcaaggacttcgacctctacaagaagtccggcatcaccgaggtggaccggacggaggcgaaggagggcctgaagcgcggggagatcacccaccacgccgtgagccggggctccgccaagctgcagtggttcgtcgagcgcaacatggtgatcccggaggggcgggtgatcgacctcggctgcgggcgcggcggctggagctactactgcgccgggctgaagaaggtcaccgaggtgcggggctacaccaagggcgggcccgggcacgaggagcccgtgcccatgtccacgtacggctggaacatcgtcaagctgatgagcggcaaggacgtgttctacctcccgcccgagaagtgcgacaccctgctgtgcgacatcggggagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccggcaacatcgtggccagcgtcaacatggtgtcccggctcctgctgaaccgcttcaccatgacgcaccggcgcccgaccatcgagaaggacgtggacctcggggcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcggccagcagcgcgtcttcaaggagaaggtggacacgcggaccccgcgctccatgcccgggacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggacagcgccaaggccgccgtggaggacgaggacttctggaagctcgtcgaccgggagcgcgagctgcacaagctggggaagtgcggcagctgcgtgtacaacatgatgggcaagcgggagaagaagctcggggagttcggcaaggccaaggggtcccgcgcgatctggtacatgtggctgggcgcccggtacctggagttcgaggccctcgggttcctgaacgaggaccactggttcagccgcgagaactcctacagcggcgtggagggcgaggggctgcacaagctcggctacatcctgcgggacatctccaagatccccgggggcgccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccgggaccgtcatggacatcatcagccggaaggaccagcgcggctccggccaggtgggcacgtacgggctgaacaccttcaccaacatggaggcccagctcatccggcagatggagggcgagggcgtgctgagcaaggccgacctggagaacccccacctcccggagaagaagatcacccagtggctggagacgaagggggtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggcgcggggtggtccctcaaggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggctccctgatcgggctgaccagccgggccacgtgggcgcagaacatcccgaccgccatccagcaggtccgcagcctcatcggcaacgaggagttcctggactacatgccctccatgaagcggttccgcaaggaggaggagagcgagggcgccatctggtga

SEQ ID NO: 10055 - RNA, 9873 nt, synthetic construct
  misc_feature 1..9873: note = derived and/or modified CDS sequence (opt1) from DENV-3__JN093515__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagcgggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccggagcaccacccgcatggagaacctgctgtggaagcagatcgcgaacgagctcaactacatcctgtgggagaacaacatcaagctgaccgtggtggtcggggacatcatcggcgtgctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgtctcccgcgcctggaacgtgtgggaggtggaggactacgggttcggcgtcttcaccaccaacatctggctcaagctgcgggaggtgtacacccagctgtgcgaccaccgcctcatgagcgcggccgtgaaggacgagcgggccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgccggggtgttcttcaccttcgtcctgctcctgtccggccagatcacctggcgggacatggcgcacacgctgatcatgatcggcagcaacgcctccgaccgcatggggatgggcgtgacctacctcgccctgatcgccaccttcaagatccagcccttcctggccctcgggttcttcctgcggaagctgaccagccgcgagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcggacggccaccctgatcctcgccggggtgagcctgctgccgatgtgccagtccagctccatgcgcaagaccgactggctccccatggcggtcgccgccatgggcgtgccgcccctcccgctgttcatcttcagcctcaaggacaccctgaagcgccggtcctggcccctgaacgagggggtgatggccgtcggcctcgtgagcatcctggcctccagcctgctccgcaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcggatcaaggacgacgagaccgagaacatcctcaccgtgctgctgaagacggccctcctgatcgtctccggcatcttcccgtacagcatccccgccaccctgctcgtgtggcacacctggcagaagcagacccagcgctccggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgcggtgctcacgtacaacgggaagcggctggagcccaactgggcctccgtgaagaaggacctgatcagctacggcgggggctggcgcctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgggagggcaaggtcgtggggctgtacggcaacggggtggtcaccaagaacggcgggtacgtgtccggcatcgcccagacgaacgccgagccggacggccccacccccgagctggaggaggagatgttcaagaagcgcaacctcaccatcatggacctgcaccccgggagcggcaagacccggaagtacctgccggccatcgtgcgcgaggcgatcaagcggcgcctccggacgctgatcctggcccccacccgcgtcgtggccgccgagatggaggaggccctcaaggggctgcccatccggtaccagaccaccgcgacgaagtccgagcacaccggccgcgagatcgtggacctgatgtgccacgccaccttcaccatgcggctcctgagccccgtccgcgtgccgaactacaacctgatcatcatggacgaggcccacttcacggaccccgcctccatcgccgcgcgggggtacatcagcacccgcgtgggcatgggcgaggccgccgccatcttcatgaccgcgacgccgcccgggacggccgacgccttcccgcagtccaacgcccccatccaggacgaggagcgcgacatccccgagcggagctggaactccggcaacgagtggatcaccgacttcgccgggaagaccgtctggttcgtgcccagcatcaaggcgggcaacgacatcgccaactgcctccgcaagaacgggaagaaggtgatccagctgtcccggaagaccttcgacacggagtaccagaagaccaagctgaacgactgggacttcgtcgtgaccaccgacatcagcgagatgggcgccaacttcaaggccgaccgcgtgatcgacccgcggcgctgcctcaagcccgtcatcctgacggacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgcgagaagtccgccgccatcgacggcgagtaccggctgaagggcgagtcccgcaagacgttcgtggagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctactccgacccgctggccctcaaggagttcaaggagttcgccgcgggccgcaagagcatcgccctggacctggtcacggagatcgggcgcgtgccctcccacctcgcccaccggacccgcaacgccctggacaacctggtgatgctccacaccagcgagcacggcgggcgggcctaccgccacgcggtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcacgctggccgccatcatcgccgcgaacgagatgggcctgctcgagaccaccaagcgcgacctgggcatgtccaaggagccgggggtcgtgagccccacctcctacctggacgtggacctccaccccgccagcgcctggacgctgtacgccgtcgcgaccaccgtgatcacccccatgctgcggcacacgatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtcatctacgactccaagttcgagaagcagctgggccaggtgatgctcctggtgctgtgcgtcgtgcagctcctgctgatgcgcaccagctgggcgctctgcgaggccctgaccctggccaccggccccatcacgaccctctgggagggctcccccgggaagttctggaacaccaccatcgccgtgagcatggcgaacatcttccggggctcctacctggccggggccggcctggccttcagcatcatgaagtccgtcgggacgggcaagcgcggcaccgggagccagggcgagaccctcggggagaagtggaagaagaagctgaaccagctgagccggaaggacttcgacctctacaagaagtccggcatcaccgaggtggaccgcaccgaggccaaggaggggctgaagcggggcgagatcacgcaccacgcggtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgccggcacccgccacgtcaacgcggagcccgagacccccaacatggacatcatcggggagcggatcaagcgcatcaaggaggagcacaacagcacctggcactacgacgacgagaacccgtacaagacgtgggcctaccacggctcctacgaggtgaaggccaccgggagcgcctccagcatgatcaacggcgtggtcaagctgctgaccaagccctgggacgtggtccccatggtgacccagatggccatgacggacaccacccccttcgggcagcagcgggtgttcaaggagaaggtcgacacccgcacgccgcggagcatgcccggcacccgccgggtgatgggcatcaccgcggagtggctctggcgcaccctggggcggaacaagaagccccgcctgtgcacgcgcgaggagttcaccaagaaggtgcggaccaacgccgccatgggcgccgtcttcaccgaggagaaccagtgggactccgcgaaggccgccgtggaggacgaggacttctggaagctcgtgaaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacacggccgggtgggacacccggatcaccgaggacgacctgcacaacgaggagaagatcacccagcagatggacccggagcaccgccagctcgcgaacgccatcttcaagctgacgtaccagaacaaggtggtcaaggtgcagcggcccacccccaccggcaccgtgatggacatcatcagccgcaaggaccagcggggctccgggcaggtcggcacctacgggctgaacacgttcaccaacatggaggcccagctcatccgccagatggagggcgagggggtgctgagcaaggccgacctggagaacccccacctcccggagaagaagatcacccagtggctggagaccaagggcgtggagcggctgaagcgcatggccatctccggcgacgactgcgtcgtgaagcccatcgacgaccggttcgcgaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctcaaggagacggcgtgcctgggcaaggcctacgcccagatgtggagcctgatgtacttccaccgccgggacctccgcctggcctccaacgcgatctgcagcgccgtccccgtgcactgggtgccgacctcccggaccacctggagcatccacgcccaccaccagtggatgacgaccgaggacatgctgaccgtctggaaccgcgtgtggatcgaggacaacccctggatggaggacaagacccccgtgacgacctgggagaacgtcccctacctcgggaagcgggaggaccagtggtgcggcagcctgatcgggctgacctcccgcgccacctgggcccagaacatcccgacggcgatccagcaggtccggagcctcatcggcaacgaggagttcctggactacatgccctccatgaagcgcttccggaaggaggaggagagcgagggggccatctggtga

SEQ ID NO: 10056 - RNA, 9873 nt, synthetic construct
  misc_feature 1..9873: note = derived and/or modified CDS sequence (opt1) from DENV-3__JF937646__SS-prME
  source 1..9873: mol_type = other RNA
accagcctgtgcctcatgatgatcctgcccgcggccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtggggatcggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacacggtcatcatcaccgtgcacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtcaccttcaagaacgcccacgccaagaagcaggaggtggtggtcctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacgcgttcgtgctgaagaaggaggtgtccgagacccagcacgggaccatcctcatcaaggtcgagtacaagggcgaggacgtgccgtgcaagatccccttcagcaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtgtcccgggcgtggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgccgacatgggctactggatcgagagccagaagaacgggtcctggaagctggagaaggcgagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgccatcctgttcgaggaggtcatgcgggggaagttcggcaagaagcacatgatcgcgggggtgttcttcaccttcgtgctgctcctgtccggccagatcacctggcgcgacatggcccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggtgaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtcgcctggcgcacggccaccctgatcctcgccggggtgagcctgctgccggtctgccagtccagctccatgcggaagaccgactggctccccatggcggtggccgccatgggcgtgccgcccctcccgctgttcatcttcgggctcaaggacaccctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcacgggcaccagcgccgacctgaccgtcgagaaggccgcggacatcacctgggaggaggaggccgagcagacgggggtgtcccacaacctgatgatcaccgtggacgacgacggcaccatgcgcatcaaggacgacgagaccgagaacatcctcaccgtcctgctgaagacggccctcctgatcgtgagcggcatcttcccgtactccatccccgccaccctgctcgtgtggcacacctggcagaagcagacccagcggagcggggtcctgtgggacgtgcccagcccgcccgagacgcagaaggccgagctggaggagggcgtgtaccgcatcaagcagcaggggatcttcggcaagacccaggtcggggtgggcgtgcagaaggagggcgtcttccacaccatgtggcacgtgacccgcggggcggtgctcacgtacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagaccacgaccggcgagatcggggcgatcgccctggacttcaagcccggcacctccggcagccccatcatcaaccgcgaggggaaggtggtgggcctgtacgggaacggcgtcgtgaccaagaacgggggctacgtgagcggcatcgcccagacgaacgccgagccggacgggcccacccccgagctggaggaggagatgttcaagaagcggaacctcaccatcatggacctgcaccccggctccgggaagacccgcaagtacctgccggccatcgtccgggaggcgatcaagcgccggctccgcacgctgatcctggcccccacccgggtggtggccgccgagatggaggaggccctcaagggcctgcccatccgctaccagaccaccgcgaccaagtccgagcacaccgggcgggagatcgtcgacctgatgtgccacgccaccttcaccatgcgcctcctgtcccccgtgcgggtgccgaactacaacctgatcatcatggacgaggcccacttcacggaccccgccagcatcgccgcgcgcggctacatctccacccgggtcggcatgggggaggccgccgccatcttcatgaccgcgacgccgcccggcacggccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggtcgggaacgacatcgcgaactgcctccggaagaacggcaagaaggtgatccagctgagccgcaagaccttcgacacggagtaccagaagaccaagctgaacgactgggacttcgtggtcaccaccgacatctccgagatgggcgccaacttcaaggccgaccgggtgatcgacccgcgccggtgcctcaagcccgtgatcctgacggacgggcccgagcgcgtcatcctggccggccccatgccggtgaccgccgcgagcgccgcccagcggcgcgggcgggtgggccgcaacccccagaaggagaacgaccagtacatcttcaccgggcagcccctcaacaacgacgaggaccacgcccactggaccgaggccaagatgctgctggacaacatcaacacccccgagggcatcatcccggccctcttcgagcccgagcgggagaagtccgccgccatcgacggcgagtaccgcctgaagggggagagccggaagacgttcgtcgagctgatgcgccggggcgacctccccgtgtggctggcccacaaggtcgcgtccgaggggatcaagtacaccgaccgcaagtggtgcttcgacggccagcggaacaaccagatcctggaggagaacatggacgtggagatctggaccaaggagggcgagaagaagaagctccgcccccggtggctggacgcccgcacctacagcgacccgctggccctcaaggagttcaaggagttcgccgccgggcgcaagtccatcgcgctggacctggtgacggagatcggccgggtccccagccacctcgcccaccgcacccggaacgccctggacaacctggtgatgctccacacctccgagcacgggggccgcgcctaccggcacgccgtggaggagctgcccgagaccatggagacgctgctcctgctggggctcatgatcctgctgaccggcggcgcgatgctgttcctgatcagcgggaagggcatcgggaagaccagcatcggcctgatctgcgtcatcgcctccagcgggatgctctggatggccgagatcccgctgcagtggatcgcctccgccatcgtgctggagttcttcatgatggtgctcctgatccccgagcccgagaagcagcgcacgccccaggacaaccagctggcgtacgtcgtgatcggcatcctcacgctggccgccatcatcgccgccaacgagatgggcctgctcgagaccaccaagcgggacctggggatgagcaaggagccgggcgtggtctcccccaccagctacctggacgtggacctccaccccgcgtccgcctggacgctgtacgccgtggccaccaccgtcatcacccccatgctgcgccacacgatcgagaacagcaccgcgaacgtgtccctcgccgccatcgccaaccaggccgtggtcctgatggggctggacaagggctggccgatcagcaagatggacctcggggtgcccctgctggcgctcggctgctactcccaggtgaaccccctgaccctgaccgccgccgtcctcctgctgatcacgcactacgccatcatcggccccgggctccaggccaaggcgacccgggaggcccagaagcgcaccgccgccggcatcatgaagaacccgaccgtggacgggatcatgacgatcgacctggaccccgtgatctacgacagcaagttcgagaagcagctgggccaggtcatgctcctggtgctgtgcgccgtgcagctcctgctgatgcggacctcctgggcgctctgcgaggccctgaccctggccaccggccccatcacgaccctctgggaggggagccccggcaagttctggaacaccaccatcgccgtctccatggcgaacatcttccgcgggagctacctggccggcgccgggctggccttctccatcatgaagtccgtgggcacgggcaagcgggggaccggctcccagggggagaccctcggcgagaagtggaagaagaagctgaaccagctgagccgcaaggacttcgacctctacaagaagtccgggatcaccgaggtggaccggaccgaggccaaggagggcctgaagcgcggcgagatcacgcaccacgcggtctcccgggggagcgccaagctgcagtggttcgtggagcgcaacatggtgatcccggagggccgggtcatcgacctcgggtgcggccgcgggggctggtcctactactgcgccggcctgaagaaggtgaccgaggtgcgggggtacaccaagggcgggcccggccacgaggagcccgtccccatgagcacctacgggtggaacatcgtgaagctgatgtccggcaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacgggggcatgctggtgcggaaccccctgagccgcaactccacgcacgagatgtactggatcagcaacgggaccggcaacatcgtcgcctccgtgaacatggtgagccggctcctgctgaaccgcttcaccatgacccaccggcgcccgacgatcgagaaggacgtcgacctcggcgccgggacccggcacgtgaacgcggagcccgagacccccaacatggacgtgatcggcgagcgcatcaagcggatcaaggaggagcacaactccacctggcactacgacgacgagaacccgtacaagacgtgggcctaccacgggagctacgaggtcaaggccaccggctccgccagctccatgatcaacggggtggtcaagctgctgaccaagccctgggacgtggtgcccatggtcacccagatggccatgacggacaccacccccttcggccagcagcgcgtgttcaaggagaaggtggacacccggacgccgcgcagcatgcccggcacccggcgcgtcatggggatcaccgcggagtggctctggcggaccctgggccgcaacaagaagccccggctgtgcacgcgcgaggagttcaccaagaaggtgcgcaccaacgccgccatgggggccgtgttcaccgaggagaaccagtgggacagcgcgaaggccgccgtcgaggacgaggacttctggaagctcgtggaccgggagcgcgagctgcacaagctgggcaagtgcgggtcctgcgtgtacaacatgatgggcaagcgggagaagaagctcggcgagttcgggaaggccaagggcagccgcgccatctggtacatgtggctgggggcgcggtacctggagttcgaggccctcggcttcctgaacgaggaccactggttctcccgcgagaacagctactccggggtcgagggcgagggcctgcacaagctcgggtacatcctgcgggacatcagcaagatccccggcggggccatgtacgccgacgacacggccggctgggacacccgcatcaccgaggacgacctgcacaacgaggagaagatcacccagcagatggacccggagcaccggcagctcgcgaacgccatcttcaagctgacgtaccagaacaaggtggtgaaggtccagcgccccacccccaccggcaccgtgatggacatcatctcccggaaggaccagcgcgggagcggccaggtggggacctacggcctgaacacgttcaccaacatggaggcccagctcatccggcagatggagggggagggcgtcctgtccaaggccgacctggagaacccccacctcccggagaagaagatcacccagtggctggagaccaagggcgtggagcgcctgaagcggatggccatcagcggggacgactgcgtggtcaagcccatcgacgaccgcttcgcgaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcccggatctcccagggcgccggctggagcctcaaggagacggcgtgcctggggaaggcctacgcccagatgtggtccctgatgtacttccaccgccgcgacctccggctggccagcaacgcgatctgctccgccgtgcccgtccactgggtgccgaccagccgcaccacctggtccatccacgcccaccaccagtggatgacgaccgaggacatgctgaccgtgtggaaccgggtctggatcgaggacaacccctggatggaggacaagacccccgtgacgacctgggagaacgtgccctacctcggcaagcgcgaggaccagtggtgcgggagcctgatcggcctgaccagccgggccacctgggcccagaacatcccgacggcgatccagcaggtccgctccctcatcgggaacgaggagttcctggactacatgcccagcatgaagcggttccgcaaggaggaggagtccgagggcgccatctggtga

SEQ ID NO: 10057 - RNA, 9873 nt, synthetic construct
  misc_feature 1..9873: note = derived and/or modified CDS sequence (opt1) from DENV-3__JF937633__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcaccctggacctggtgaccgagatcggccgggtgcccagccacctcgcccaccgcacccggaacgccctggacaacctggtcatgctccacacgtccgagcacgggggccgcgcctaccggcacgccgtggaggagctgcccgagaccatggagaccctgctcctgctggggctcatgatcctgctgaccggcggcgcgatgctgttcctgatcagcgggaagggcatcgggaagacgagcatcggcctgatctgcgtgatcgcctccagcgggatgctctggatggccgagatcccgctgcagtggatcgcctccgccatcgtcctggagttcttcatgatggtgctcctgatccccgagcccgagaagcagcgcacgccccaggacaaccagctggcgtacgtggtcatcggcatcctcaccctggccgccatcatcgccgccaacgagatgggcctgctcgagaccacgaagcgggacctggggatgagcaaggagccgggcgtggtgtcccccaccagctacctggacgtcgacctccaccccgcgtccgcctggaccctgtacgccgtggccaccacggtgatcacccccatgctgcgccacaccatcgagaacagcaccgcgaacgtctccctcgccgccatcgccaaccaggccgtggtgctgatggggctggacaagggctggccgatcagcaagatggacctcggggtccccctgctggcgctcggctgctactcccaggtgaaccccctgacgctgaccgccgccgtgctcctgctgatcacccactacgccatcatcggccccgggctccaggccaaggcgacccgggaggcccagaagcgcacggccgccggcatcatgaagaacccgaccgtcgacgggatcatgaccatcgacctggaccccgtgatctacgacagcaagttcgagaagcagctgggccaggtgatgctcctggtcctgtgcgccgtgcagctcctgctgatgcggacctcctgggcgctctgcgaggccctgacgctggccaccggccccatcaccaccctctgggaggggagccccggcaagttctggaacacgaccatcgccgtgtccatggcgaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcacggaggtggaccggaccgaggccaaggagggcctgaagcgcggcgagatcacccaccacgcggtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacacgaagggcgggcccggccacgaggagcccgtgcccatgagcacctacgggtggaacatcgtcaagctgatgtccggcaaggacgtgttctacctcccgcccgagaagtgcgacaccctgctgtgcgacatcggcgagagctcccccagccccaccgtggaggagtcccgcacgatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcacgatgacccaccggcgcccgaccatcgagaaggacgtggacctcggcgccgggacccggcacgtcaacgcggagcccgagacgcccaacatggacgtgatcggcgagcgcatcaagcggatcaaggaggagcacaactccacctggcactacgacgacgagaacccgtacaagacctgggcctaccacgggagctacgaggtgaaggccaccggctccgccagctccatgatcaacggggtcgtgaagctgctgacgaagccctgggacgtcgtgcccatggtgacccagatggccatgaccgacaccacgcccttcggccagcagcgcgtcttcaaggagaaggtggacacccggaccccgcgcagcatgcccggcacccggcgcgtgatggggatcacggcggagtggctctggcggaccctgggccgcaacaagaagccccggctgtgcacccgcgaggagttcaccaagaaggtccgcacgaacgccgccatgggggccgtgttcaccgaggagaaccagtgggacagcgcgaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgccatctggtacatgtggctgggggcgcggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgccggctgggacacccgcatcacggaggacgacctgcacaacgaggagaagatcacccagcagatggacccggagcaccggcagctcgcgaacgccatcttcaagctgacctaccagaacaaggtcgtgaaggtgcagcgccccacccccaccggcacggtcatggacatcatctcccggaaggaccagcgcgggagcggccaggtggggacctacggcctgaacaccttcaccaacatggaggcccagctcatccggcagatggagggggagggcgtgctgtccaaggccgacctggagaacccccacctcccggagaagaagatcacgcagtggctggagaccaagggcgtcgagcgcctgaagcggatggccatcagcggggacgactgcgtggtgaagcccatcgacgaccgcttcgcgaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgccggctggagcctcaaggagaccgcgtgcctggggaaggcctacgcccagatgtggtccctgatgtacttccaccgccgcgacctccggctggccagcaacgcgatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcggcaagcgcgaggaccagtggtgcgggagcctgatcggcctgacgagccgggccacctgggcccagaacatcccgaccgcgatccagcaggtccgctccctcatcgggaacgaggagttcctggactacatgcccagcatgaagcggttccgcaaggaggaggagtccgagggcgccatctggtga

SEQ ID NO: 10058 - RNA, 9873 nt, synthetic construct
  misc_feature 1..9873: note = derived and/or modified CDS sequence (opt1) from DENV-3__JF937634__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgtgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcgaagatcgtcaccgccgagacgcagaacagctccttcatcatcgacggccccaacacccccgagtgccccagcgtgtcccgggcctggaacgtgtgggaggtcgaggactacgggttcggcgtgttcaccaccaacatctggctcaagctgcgcgaggtgtacacccagctgtgcgaccaccggctcatgagcgccgcggtcaaggacgagcgcgccgtgcacgccgacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggccgggcccatctcccagcacaaccaccggccgggctaccacacccagacggcggggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacacgctgatcatgatcggcagcaacgcgtccgaccggatggggatgggcgtgacctacctcgccctgatcgccaccttcaagatccagcccttcctggccctcgggttcttcctgcgcaagctgaccagccgggagaacctcctgctgggcgtcggcctcgccatggcgacgaccctgcagctgcccgaggacatcgagcagatggccaacgggatcgccctcggcctgatggccctgaagctcatcacccagttcgagacctaccagctgtggacggcgctgatcagcctgacctgctccaacaccatcttcaccctgacggtggcctggcgcaccgccaccctgatcctcgccggggtcagcctgctgccggtgtgccagtccagctccatgcggaagaccgactggctccccatggccgtggcggccatgggcgtgccgcccctcccgctgttcatcttcgggctcaaggacacgctgaagcgccgcagctggcccctgaacgagggcgtgatggccgtgggcctcgtctccatcctggccagctccctgctccggaacgacgtgcccatggccgggcccctggtggcgggcgggctgctcatcgcctgctacgtcatcaccggcaccagcgccgacctgaccgtggagaaggccgccgacatcacgtgggaggaggaggcggagcagaccggggtgtcccacaacctgatgatcaccgtcgacgacgacggcaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggggtgctgtgggacgtgcccagcccgcccgagacccagaaggccgagctggaggagggcgtctaccgcatcaagcagcaggggatcttcggcaagacccaggtgggggtgggcgtccagaaggagggcgtgttccacaccatgtggcacgtgacgcgcggggcggtcctcacctacaacggcaagcgcctggagcccaactgggcgagcgtgaagaaggacctgatctcctacgggggcgggtggcggctcagcgcccagtggcagaagggcgaggaggtgcaggtcatcgccgtggagcccggcaagaaccccaagaacttccagaccatgcccgggaccttccagacgaccaccggcgagatcggggccatcgcgctggacttcaagcccggcacctccggcagccccatcatcaaccgcgaggggaaggtggtcggcctgtacgggaacggcgtggtgacgaagaacgggggctacgtcagcggcatcgcccagaccaacgccgagccggacgggcccacccccgagctggaggaggagatgttcaagaagcggaacctcaccatcatggacctgcaccccggctccgggaagacgcgcaagtacctgccggccatcgtgcgggaggccatcaagcgccggctccgcaccctgatcctggcgcccacccgggtggtcgccgccgagatggaggaggccctcaagggcctgcccatccgctaccagaccacggccaccaagagcgagcacaccgggcgggagatcgtggacctgatgtgccacgcgaccttcacgatgcgcctcctgtcccccgtgcgggtcccgaactacaacctgatcatcatggacgaggcccacttcaccgaccccgccagcatcgccgcccgcggctacatctccacccgggtgggcatgggggaggcggccgccatcttcatgaccgccacgccgcccggcaccgcggacgccttcccgcagagcaacgcccccatccaggacgaggagcgcgacatccccgagcgctcctggaacagcgggaacgagtggatcaccgacttcgccggcaagaccgtgtggttcgtcccctccatcaaggccgggaacgacatcgcgaactgcctccggaagaacggcaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacgggcccgagcgcgtcatcctggccggccccatgccggtgaccgccgcgagcgccgcccagcggcgcgggcgggtgggccgcaacccccagaaggagaacgaccagtacatcttcaccgggcagcccctcaacaacgacgaggaccacgcccactggaccgaggccaagatgctgctggacaacatcaacacgcccgagggcatcatcccggccctcttcgagcccgagcgggagaagtccgccgccatcgacggcgagtaccgcctgaagggggagagccggaagaccttcgtcgagctgatgcgccggggcgacctccccgtgtggctggcccacaaggtcgcgtccgaggggatcaagtacaccgaccgcaagtggtgcttcgacggccagcggaacaaccagatcctggaggagaacatggacgtggagatctggaccaaggagggcgagaagaagaagctccgcccccggtggctggacgcccgcacgtacagcgacccgctggccctcaaggagttcaaggagttcgccgccgggcgcaagtccatcgcgctggacctggtgaccgagatcggccgggtccccagccacctcgcccaccgcacccggaacgccctggacaacctggtgatgctccacacctccgagcacgggggccgcgcctaccggcacgccgtggaggagctgcccgagacgatggagaccctgctcctgctggggctcatgatcctgctgaccggcggcgcgatgctgttcctgatcagcgggaagggcatcgggaagaccagcatcggcctgatctgcgtcatcgcctccagcgggatgctctggatggccgagatcccgctgcagtggatcgcctccgccatcgtgctggagttcttcatgatggtgctcctgatccccgagcccgagaagcagcgcacgccccaggacaaccagctggcgtacgtcgtgatcggcatcctcaccctggccgccatcatcgccgccaacgagatgggcctgctcgagaccaccaagcgggacctggggatgagcaaggagccgggcgtggtctcccccacgagctacctggacgtggacctccaccccgcgtccgcctggaccctgtacgccgtggccaccaccgtcatcacgcccatgctgcgccacaccatcgagaacagcaccgcgaacgtgtccctcgccgccatcgccaaccaggccgtggtcctgatggggctggacaagggctggccgatcagcaagatggacctcggggtgcccctgctggcgctcggctgctactcccaggtgaaccccctgaccctgacggccgccgtcctcctgctgatcacccactacgccatcatcggccccgggctccaggccaaggcgacccgggaggcccagaagcgcaccgccgccggcatcatgaagaacccgacggtggacgggatcatgaccatcgacctggaccccgtgatctacgacagcaagttcgagaagcagctgggccaggtcatgctcctggtgctgtgcgccgtgcagctcctgctgatgcggacctcctgggcgctctgcgaggccctgaccctggccacgggccccatcaccaccctctgggaggggagccccggcaagttctggaacaccacgatcgccgtctccatggcgaacatcttccgcgggagctacctggccggcgccgggctggccttctccatcatgaagtccgtgggcaccggcaagcgggggaccggctcccagggggagaccctcggcgagaagtggaagaagaagctgaaccagctgagccgcaaggacttcgacctctacaagaagtccgggatcaccgaggtggaccggacggaggccaaggagggcctgaagcgcggcgagatcacccaccacgcggtctcccgggggagcgccaagctgcagtggttcgtggagcgcaacatggtgatcccggagggccgggtcatcgacctcgggtgcggccgcgggggctggtcctactactgcgccggcctgaagaaggtgaccgaggtgcgggggtacaccaagggcgggcccggccacgaggagcccgtccccatgagcacgtacgggtggaacatcgtgaagctgatgtccggcaaggacgtgttctacctcccgcccgagaagtgcgacaccctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccacggtgatcgagcacctggagcggctccagcgcaagcacgggggcatgctggtgcggaaccccctgagccgcaactccacccacgagatgtactggatcagcaacgggaccggcaacatcgtcgcctccgtgaacatggtgagccggctcctgctgaaccgcttcaccatgacgcaccggcgcccgaccatcgagaaggacgtcgacctcggcgccgggacccggcacgtgaacgcggagcccgagacccccaacatggaggtgatcggcgagcgcatcaagcggatcaaggaggagcacaactccacgtggcactacgacgacgagaacccgtacaagacctgggcctaccacgggagctacgaggtcaaggccaccggctccgccagctccatgatcaacggggtggtcaagctgctgaccaagccctgggacgtggtgcccatggtcacgcagatggccatgaccgacaccacccccttcggccagcagcgcgtgttcaaggagaaggtggacacgcggaccccgcgcagcatgcccggcacccggcgcgtcatggggatcaccgcggagtggctctggcggacgctgggccgcaacaagaagccccggctgtgcacccgcgaggagttcaccaagaaggtgcgcaccaacgccgccatgggggccgtgttcacggaggagaaccagtgggacagcgcgaaggccgccgtcgaggacgaggacttctggaagctcgtggaccgggagcgcgagctgcacaagctgggcaagtgcgggtcctgcgtgtacaacatgatgggcaagcgggagaagaagctcggcgagttcgggaaggccaagggcagccgcgccatctggtacatgtggctgggggcgcggtacctggagttcgaggccctcggcttcctgaacgaggaccactggttctcccgcgagaacagctactccggggtcgagggcgagggcctgcacaagctcgggtacatcctgcgggacatcagcaagatccccggcggggccatgtacgccgacgacaccgccggctgggacacccgcatcaccgaggacgacctgcacaacgaggagaagatcacgcagcagatggacccggagcaccggcagctcgcggacgccatcttcaagctgacctaccagaacaaggtggtgaaggtccagcgccccacccccaccggcaccgtgatggacatcatctcccggaaggaccagcgcgggagcggccaggtggggacgtacggcctgaacaccttcaccaacatggaggcccagctcatccggcagatggagggggagggcgtcctgtccaaggccgacctggagaacccccacctcccggagaagaagatcacccagtggctggagacgaagggcgtggagcgcctgaagcggatggccatcagcggggacgactgcgtggtcaagcccatcgacgaccgcttcgcgaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcccggatctcccagggcgccggctggagcctcaaggagaccgcgtgcctggggaaggcctacgcccagatgtggtccctgatgtacttccaccgccgcgacctccggctggccagcaacgcgatctgctccgccgtgcccgtccactgggtgccgaccagccgcaccacgtggtccatccacgcccaccaccagtggatgaccaccgaggacatgctgaccgtgtggaaccgggtctggatcgaggacaacccctggatggaggacaagacgcccgtgaccacctgggagaacgtgccctacctcggcaagcgcgaggaccagtggtgcgggagcctgatcggcctgaccagccgggccacgtgggcccagaacatcccgaccgcgatccagcaggtccgctccctcatcgggaacgaggagttcctggactacatgcccagcatgaagcggttccgcaaggaggaggagtccgagggcgccatctggtga

SEQ ID NO: 10059 - RNA, 9873 nt, synthetic construct
  misc_feature 1..9873: note = derived and/or modified CDS sequence (opt1) from DENV-3__JF937636__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcatcctgtgcctcgccatcctgttcgaggaggtcatgcgggggaagttcggcaagaagcacatgatcgccggggtgttcttcaccttcgtgctgctcctgtccggccagatcacctggcgcgacatggcgcacacgctgatcatgatcggcagcaacgcctccgaccggatggggatgggcgtcacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtggcctggcgcaccgccaccctgatcctcgccggggtcagcctgctgccggtgtgccagtccagctccatgcggaagaccgactggctccccatggcggtcgccgccatgggcgtgccgcccctcccgctgttcatcttcagcctcaaggacacgctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcaccgggacctccgccgacctgaccgtggagaaggccgcggacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatccgccggcgcctccggaccctgatcctggcccccacccgcgtcgtggccgccgagatggaggaggccctcaaggggctgcccatccggtaccagaccacggcgaccaagtccgagcacaccggccgcgagatcgtggacctgatgtgccacgccaccttcacgatgcggctcctgagccccgtccgcgtgccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtctggttcgtgcccagcatcaaggcgggcaacgacatcgccaactgcctccgcaagaacgggaagaaggtgatccagctgtcccggaagacgttcgacaccgagtaccagaagaccaagctgaacgactgggacttcgtcgtgaccacggacatcagcgagatgggcgccaacttcaaggccgaccgcgtgatcgacccgcggcgctgcctcaagcccgtcatcctgaccgacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggagttcgccgcgggccgcaagagcatcgccctggacctggtcaccgagatcgggcgcgtgccctcccacctcgcccaccggacccgcaacgccctggacaacctggtgatgctccacaccagcgagcacggcgggcgggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggacttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccgcaccatccgggtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgcgggcacccgccacgtgaacgccgagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtggtcaagctgctgaccaagccctgggacgtggtccccatggtgacgcagatggcgatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgcgaggagttcaccaagaaggtgcggaccaacgccgccatgggcgcggtcttcacggaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctcaaggagaccgcctgcctgggcaaggcctacgcccagatgtggagcctgatgtacttccaccgccgggacctccgcctggcgtccaacgccatctgcagcgccgtccccgtgcactgggtgccgacctcccggaccacgtggagcatccacgcccaccaccagtggatgaccaccgaggacatgctgaccgtctggaaccgcgtgtggatcgaggacaacccctggatggaggacaagacgcccgtgaccacctgggagaacgtcccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10060 - RNA, 9873 nt, synthetic construct
  misc_feature 1..9873: note = derived and/or modified CDS sequence (opt1) from DENV-3__JF937626__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatgacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtggtgccggagggccgggtcatcgacctcgggtgcggccgcgggggctggtcctactactgcgccggcctgaagaaggtgaccgaggtgcgggggtacaccaagggcgggcccggccacgaggagcccgtccccatgagcacgtacgggtggaacatcgtgaagctgatgtccggcaaggacgtgttctacctcccgcccgagaagtgcgacaccctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccacggtgatcgagcacctggagcggctccagcgcaagcacgggggcatgctggtgcggaaccccctgagccgcaactccacccacgagatgtactggatcagcaacgggaccggcaacatcgtcgcctccgtgaacatggtgagccggctcctgctgaaccgcttcaccatgacgcaccggcgcccgaccatcgagaaggacgtcgacctcggcgcggggacccggcacgtgaacgccgagcccgagacccccaacatggacgtgatcggcgagcgcatcaagcggatcaaggaggagcacaactccacgtggcactacgacgacgagaacccgtacaagacctgggcctaccacgggagctacgaggtcaaggccaccggctccgccagctccatgatcaacggggtggtcaagctgctgaccaagccctgggacgtggtgcccatggtcacgcagatggcgatgaccgacaccacccccttcggccagcagcgcgtgttcaaggagaaggtggacacgcggaccccgcgcagcatgcccggcacccggcgcgtcatggggatcaccgccgagtggctctggcggacgctgggccgcaacaagaagccccggctgtgcacccgcgaggagttcaccaagaaggtgcgcaccaacgccgccatgggggcggtgttcacggaggagaaccagtgggacagcgccaaggccgccgtcgaggacgaggacttctggaagctcgtggaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtcgagggcgagggcctgcacaagctcgggtacatcctgcgggacatcagcaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatctcccggaaggaccagcgcgggagcggccaggtggggacgtacggcctgaacaccttcaccaacatggaggcccagctcatccggcagatggagggggagggcgtcctgtccaaggccgacctggagaacccccacctcccggagaagaagatcacccagtggctggagacgaagggcgtggagcgcctgaagcggatggcgatcagcggggacgactgcgtggtcaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtccactgggtgccgaccagccgcaccacgtggtccatccacgcccaccaccagtggatgaccaccgaggacatgctgaccgtgtggaaccgggtctggatcgaggacaacccctggatggaggacaagacgcccgtgaccacctgggagaacgtgccctacctcggcaagcgcgaggaccagtggtgcgggagcctgatcggcctgaccagccgggccacgtgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10061 - RNA, 9873 nt, synthetic construct
  misc_feature 1..9873: note = derived and/or modified CDS sequence (opt1) from DENV-3__JF937621__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagcgcgccgcggacatcacgtgggaggaggaggccgagcagaccggggtgtcccacaacctgatgatcaccgtggacgacgacggcaccatgcggatcaaggacgacgagaccgagaacatcctcacggtcctgctgaagaccgccctcctgatcgtgagcggcatcttcccgtactccatccccgccaccctgctcgtgtggcacacctggcagaagcagacgcagcgcagcggggtcctgtgggacgtgcccagcccgcccgagacccagaaggccgagctggaggagggcgtgtaccggatcaagcagcaggggatcttcggcaagacccaggtcggggtgggcgtgcagaaggagggcgtcttccacaccatgtggcacgtgacgcgcggggcggtgctcacctacaacggcaagcggctggagcccaactgggccagcgtcaagaaggacctgatctcctacgggggcgggtggcgcctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgggaggggaaggtggtgggcctgtacgggaacggcgtcgtgacgaagaacgggggctacgtgagcggcatcgcccagaccaacgccgagccggacgggcccacccccgagctggaggaggagatgttcaagaagcgcaacctcaccatcatggacctgcaccccggctccgggaagacgcggaagtacctgccggccatcgtccgcgaggcgatcaagcggcgcctccggaccctgatcctggcccccacccgcgtggtggccgccgagatggaggaggccctcaagggcctgcccatccggtaccagaccacggcgaccaagagcgagcacaccgggcgcgagatcgtcgacctgatgtgccacgccaccttcacgatgcggctcctgtcccccgtgcgcgtgccgaactacaacctgatcatcatggacgaggcccacttcaccgaccccgccagcatcgccgcgcggggctacatctccacccgcgtcggcatgggggaggccgccgccatcttcatgaccgcgacgccgcccggcaccgccgacgccttcccgcagagcaacgcccccatccaggacgaggagcgcgacatccccgagcggtcctggaacagcgggaacgagtggatcaccgacttcgccggcaagaccgtgtggttcgtgccctccatcaaggcggggaacgacatcgccaactgcctccgcaagaacggcaagaaggtcatccagctgagccggaagacgttcgacaccgagtaccagaagaccaagctgaacgactgggacttcgtggtgaccacggacatctccgagatgggcgccaacttcaaggccgaccgcgtcatcgacccgcggcgctgcctcaagcccgtgatcctgaccgacgggcccgagcgggtgatcctggccggccccatgccggtcaccgcggccagcgccgcccagcgccgggggcgcgtgggccggaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgcgagaagtccgccgccatcgacggcgagtaccggctgaagggggagagccgcaagaccttcgtggagctgatgcggcgcggcgacctccccgtctggctggcgcacaaggtggcctccgaggggatcaagtacaccgaccggaagtggtgcttcgacggccagcgcaacaaccagatcctggaggagaacatggacgtcgagatctggaccaaggagggcgagaagaagaagctccggccccgctggctggacgcccgcacgtacagcgacccgctggccctcaaggagttcaaggagttcgccgcggggcggaagtccatcgccctggacctggtgaccgagatcggccgcgtgcccagccacctcgcccaccggacccgcaacgccctggacaacctggtcatgctccacacctccgagcacgggggccgggcctaccgccacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcggacgccccaggacaaccagctggcctacgtggtcatcggcatcctcaccctggccgccatcatcgccgcgaacgagatgggcctgctcgagaccaccaagcgcgacctggggatgagcaaggagccgggcgtggtgtcccccacgagctacctggacgtcgacctccaccccgcctccgcctggaccctgtacgccgtggcgaccaccgtgatcacgcccatgctgcggcacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgcgaggcccagaagcggaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcgcacctcctgggccctctgcgaggccctgaccctggccacgggccccatcaccaccctctgggaggggagccccggcaagttctggaacaccacgatcgcggtgtccatggccaacatcttccgggggagctacctggccggcgccgggctggccttctccatcatgaagtccgtcggcaccggcaagcgcgggaccggctcccagggggagaccctcggcgagaagtggaagaagaagctgaaccagctgagccggaaggacttcgacctctacaagaagtccgggatcaccgaggtggaccgcacggaggcgaaggagggcctgaagcggggcgagatcacccaccacgccgtgtcccgcgggagcgccaagctgcagtggttcgtcgagcggaacatggtgatcccggagggccgcgtgatcgacctcgggtgcggccgcgggggctggtcctactactgcgccggcctgaagaaggtcaccgaggtgcgcgggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgggtcctgaagatggtggagccgtggctcaagaacaaccagttctgcatcaaggtgctgaacccctacatgcccacggtcatcgagcacctggagcgcctccagcggaagcacgggggcatgctggtgcgcaaccccctgagccggaactccacccacgagatgtactggatcagcaacgggaccggcaacatcgtggcctccgtcaacatggtgagccgcctcctgctgaaccggttcaccatgacgcaccgccggccgaccatcgagaaggacgtggacctcggcgcggggacccgccacgtcaacgccgagcccgagacccccaacatggacgtgatcggcgagcggatcaagcgcatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggcgatgaccgacaccacccccttcggccagcagcgggtcttcaaggagaaggtggacacgcgcaccccgcggagcatgcccggcacccgccgggtgatggggatcaccgccgagtggctctggcgcacgctgggccggaacaagaagccccgcctgtgcacccgcgaggagttcaccaagaaggtccggaccaacgccgccatgggggcggtgttcacggaggagaaccagtgggacagcgccaaggccgccgtggaggacgaggacttctggaagctcgtcgaccgcgagcgggagctgcacaagctgggcaagtgcgggtcctgcgtgtacaacatgatgggcaagcgcgagaagaagctcggcgagttcgggaaggccaagggcagccgggcgatctggtacatgtggctgggggcccgctacctggagttcgaggccctcggcttcctgaacgaggaccactggttctcccgggagaacagctactccggggtggagggcgagggcctgcacaagctcgggtacatcctgcgcgacatcagcaagatccccggcggggccatgtacgccgacgacaccgcgggctgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatctcccgcaaggaccagcgggggagcggccaggtggggacgtacggcctgaacaccttcaccaacatggaggcccagctcatccgccagatggagggggagggcgtgctgtccaaggccgacctggagaacccccacctcccggagaagaagatcacccagtggctggagacgaagggcgtcgagcggctgaagcgcatggcgatcagcggggacgactgcgtggtgaagcccatcgacgaccggttcgccaacgccctcctggccctgaacgacatgggcaaggtccgcaaggacatcccccagtggcagccctccaaggggtggcacgactggcagcaggtcccgttctgcagccaccacttccacgagctcatcatgaaggacggccggaagctggtggtcccctgccgcccccaggacgagctgatcgggcgggcccgcatctcccagggcgcgggctggagcctcaaggagaccgcctgcctggggaaggcctacgcccagatgtggtccctgatgtacttccaccgccgggacctccgcctggcgagcaacgccatctgctccgccgtgcccgtgcactgggtcccgaccagccggaccacgtggtccatccacgcccaccaccagtggatgaccaccgaggacatgctgaccgtgtggaaccgcgtgtggatcgaggacaacccctggatggaggacaagacgcccgtcaccacctgggagaacgtgccctacctcggcaagcgggaggaccagtggtgcgggagcctgatcggcctgaccagccgcgccacgtgggcgcagaacatcccgaccgccatccagcaggtccggtccctcatcgggaacgaggagttcctggactacatgcccagcatgaagcgcttccggaaggaggaggagtccgagggcgccatctggtga

SEQ ID NO: 10062 - RNA, 9873 nt, synthetic construct
  misc_feature 1..9873: note = derived and/or modified CDS sequence (opt1) from DENV-3__JF937623__SS-prME
  source 1..9873: mol_type = other RNA
gccagcctgtgcctcatgatgatcctgcccgccgccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgacgagcacctgggtgacctacgggacctgcaaccaggccggcgagcaccggcgcgacaagcggtccgtcgcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccacgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcggggatcttcttcaccttcgtgctgctcctgtccggccagatcacctggcgcgacatggcccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatggccgtcgccgccatgggcgtgccgcccctcccgctgttcatcttcgggctcaaggacaccctgaagcgccgcagctggcccctgaacgagggcgtgatggccgtcggcctcgtgtccatcctggcgagctccctgctccggaacgacgtgcccatggccgggcccctggtcgccggcgggctgctcatcgcctgctacgtgatcacgggcaccagcgccgacctgaccgtggagaaggcggccgacatgacctgggaggaggaggccgagcagacgggggtctcccacaacctgatgatcaccgtggacgacgacggcaccatgcgcatcaaggacgacgagaccgagaacatcctcaccgtgctgctgaagacggccctcctgatcgtcagcggcatcttcccgtactccatccccgccaccctgctcgtgtggcacacctggcagaagcagacccagcggagcggggtgctgtgggacgtccccagcccgcccgagacgcagaaggcggagctggaggagggcatctaccgcatcaagcagcaggggatcttcggcaagacccaggtgggggtgggcgtccagaaggagggcgtgttccacaccatgtggcacgtgacccgcggggccgtcctcacgtacaacggcaagcgcctggagcccaactgggccagcgtgaagaaggacctgatctcctacgggggcgggtggcggctcagcgcccagtggcagaagggcgaggaggtgcaggtcatcgcggtggagcccggcaagaaccccaagaacttccagaccatgcccgggaccttccagaccacgaccggcgagatcggggccatcgccctggacttcaagcccggcacctccggcagccccatcatcaaccgcgaggggaaggtggtcggcctgtacgggaacggcgtggtgaccaagaacgggggctacgtcagcggcatcgcccagacgaacgccgagccggacgggcccacccccgagctggaggaggagatgttcaagaagcggaacctcaccatcatggacctgcaccccggctccgggaagacccgcaagtacctgccggcgatcgtgcgggaggccatcaagcgccggctccgcacgctgatcctggcccccacccgggtggtcgccgccgagatggaggaggcgctcaagggcctgcccatccgctaccagaccaccgccaccaagtccgagcacaccgggcgggagatcgtggacctgatgtgccacgccaccttcaccatgcgcctcctgtcccccgtgcgggtcccgaactacaacctgatcatcatggacgaggcccacttcacggaccccgccagcatcgcggcccgcggctacatctccacccgggtgggcatgggggaggccgccgcgatcttcatgaccgccacgccgcccggcacggccgacgccttcccgcagagcaacgcccccatccaggacgaggagcgcgacatccccgagcgctcctggaacagcgggaacgagtggatcaccgacttcgcgggcaagaccgtgtggttcgtcccctccatcaaggccgggaacgacatcgccaactgcctccggaagaacggcaagaaggtgatccagctgagccgcaagaccttcgacacggagtaccagaagaccaagctgaacgactgggacttcgtggtcaccaccgacatctccgagatgggcgccaacttcaaggccgaccgggtgatcgacccgcgccggtgcctcaagcccgtgatcctgacggacgggcccgagcgcgtcatcctggcgggccccatgccggtgaccgccgccagcgccgcccagcggcgcgggcgggtgggccgcaacccccagaaggagaacgaccagtacatcttcaccgggcagcccctcaacaacgacgaggaccacgcgcactggaccgaggccaagatgctgctggacaacatcaacacccccgagggcatcatcccggccctcttcgagcccgagcgggagaagtccgccgcgatcgacggcgagtaccgcctgaagggggagagccggaagacgttcgtcgagctgatgcgccggggcgacctccccgtgtggctggcccacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacctacagcgacccgctggccctcaaggagttcaaggagttcgcggccgggcgcaagtccatcgccctggacctggtgacggagatcggccgggtccccagccacctcgcccaccgcacccggaacgccctggacaacctggtgatgctccacacctccgagcacgggggccgcgcgtaccggcacgccgtggaggagctgcccgagaccatggagacgctgctcctgctggggctcatgatcctgctgaccggcggcgccatgctgttcctgatcagcgggaagggcatcgggaagaccagcatcggcctgatctgcgtcatcgcctccagcgggatgctctggatggccgagatcccgctgcagtggatcgcgtccgccatcgtgctggagttcttcatgatggtgctcctgatccccgagcccgagaagcagcgcacgccccaggacaaccagctggcctacgtcgtgatcggcatcctcacgctggccgccatcatcgcggccaacgagatgggcctgctcgagaccaccaagcgggacctggggatgagcaaggagccgggcgtggtctcccccaccagctacctggacgtggacctccaccccgcctccgcctggacgctgtacgcggtggccaccaccgtcatcacccccatgctgcgccacacgatcgagaacagcaccgccaacgtgtccctcgccgccatcgcgaaccaggccgtggtcctgatggggctggacaagggctggccgatcagcaagatggacctcggggtgcccctgctggccctcggctgctactcccaggtgaaccccctgaccctgaccgccgccgtcctcctgctgatcacgcactacgcgatcatcggccccgggctccaggccaaggccacccgggaggcccagaagcgcaccgccgcgggcatcatgaagaacccgaccgtggacgggatcatgacgatcgacctggaccccgtgatctacgacagcaagttcgagaagcagctgggccaggtcatgctcctggtgctgtgcgccgtgcagctcctgctgatgcggacctcctgggccctctgcgaggccctgaccctggcgaccggccccatcacgaccctctgggaggggagccccggcaagttctggaacaccaccatcgccgtctccatggccaacatcttccgcgggagctacctggccggcgccgggctggcgttctccatcatgaagtccgtgggcacgggcaagcgggggaccggctcccagggggagaccctcggcgagaagtggaagaagaagctgaaccagctgagccgcaaggacttcgacctctacaagaagtccgggatcaccgaggtggaccggaccgaggccaaggagggcctgaagcgcggcgagatcacgcaccacgccgtctcccgggggagcgccaagctgcagtggttcgtggagcgcaacatggtgatcccggagggccgggtcatcgacctcgggtgcggccgcgggggctggtcctactactgcgccggcctgaagaaggtgaccgaggtgcgggggtacaccaagggcgggcccggccacgaggagcccgtccccatgagcacctacgggtggaacatcgtgaagctgatgtccggcaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacgggggcatgctggtgcggaaccccctgagccgcaactccacgcacgagatgtactggatcagcaacgggaccggcaacatcgtcgcgtccgtgaacatggtgagccggctcctgctgaaccgcttcaccatgacccaccggcgcccgacgatcgagaaggacgtcgacctcggcgccgggacccggcacgtgaacgccgagcccgagacccccaacatggacgtgatcggcgagcgcatcaagcggatcaaggaggagcacaactccacctggcactacgacgacgagaacccgtacaagacgtgggcctaccacgggagctacgaggtcaaggccaccggctccgcgagctccatgatcaacggggtggtgaagctgctgaccaagccctgggacgtcgtgcccatggtcacccagatggccatgacggacaccacccccttcggccagcagcgcgtgttcaaggagaaggtggacacccggacgccgcgcagcatgcccggcacccggcgcgtcatggggatcaccgccgagtggctctggcggaccctgggccgcaacaagaagccccggctgtgcacgcgcgaggagttcaccaagaaggtgcgcaccaacgccgcgatgggggccgtgttcaccgaggagaaccagtgggacagcgccaaggccgccgtcgaggacgaggacttctggaagctcgtggaccgggagcgcgagctgcacaagctgggcaagtgcgggtcctgcgtgtacaacatgatgggcaagcgggagaagaagctcggcgagttcgggaaggcgaagggcagccgcgccatctggtacatgtggctgggggcccggtacctggagttcgaggccctcggcttcctgaacgaggaccactggttctcccgcgagaacagctactccggggtcgagggcgagggcctgcacaagctcgggtacatcctgcgggacatcagcaagatccccggcggggccatgtacgcggacgacacggccggctgggacacccgcatcaccgaggacgacctgcacaacgaggagaagatcacccagcagatggacccggagcaccggcagctcgccaacgccatcttcaagctgacgtaccagaacaaggtggtgaaggtccagcgccccacccccaccggcaccgtgatggacatcatctcccggaaggaccagcgcgggagcggccaggtggggacctacggcctgaacacgttcaccaacatggaggcccagctcatccggcagatggagggggagggcgtcctgtccaaggcggacctggagaacccccacctcccggagaagaagatcacccagtggctggagaccaagggcgtggagcgcctgaagcggatggccatcagcggggacgactgcgtggtcaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcgcggatctcccagggcgccggctggagcctcaaggagacggcctgcctggggaaggcctacgcgcagatgtggtccctgatgtacttccaccgccgcgacctccggctggccagcaacgccatctgctccgccgtgcccgtccactgggtgccgaccagccgcaccacctggtccatccacgcccaccaccagtggatgacgaccgaggacatgctgaccgtgtggaaccgggtctggatcgaggacaacccctggatggaggacaagacccccgtgacgacctgggagaacgtgccctacctcggcaagcgcgaggaccagtggtgcgggagcctgatcggcctgaccagccgggcgacctgggcccagaacatcccgacggccatccagcaggtccgctccctcatcgggaacgaggagttcctggactacatgcccagcatgaagcggttccgcaaggaggaggagtccgagggcgccatctggtga

SEQ ID NO: 10063 - RNA, 9873 nt, synthetic construct
  misc_feature 1..9873: note = derived and/or modified CDS sequence (opt1) from DENV-3__JF937637__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacgcgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgtctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcgggctcaaggacaccctgaagcgccgcagctggcccctgaacgagggcgtcatggccgtgggcctcgtgtccatcctggcgagctccctgctccggaacgacgtccccatggccgggcccctggtggccggcgggctgctcatcgcctgctacgtgatcacgggcaccagcgccgacctgaccgtcgagaaggcggccgacatcacctgggaggaggaggccgagcagacgggggtgtcccacaacctgatgatcaccgtggacgacgacggcaccatgcgcatcaaggacgacgagaccgagaacatcctcaccgtcctgctgaagacggccctcctgatcgtgagcggcatcttcccgtactccatccccgccaccctgctcgtgtggcacacctggcagaagcagacccagcggagcggggtcctgtgggacgtgcccagcccgcccgagacgcagaaggcggagctggaggagggcgtgtaccgcatcaagcagcaggggatcttcggcaagacccaggtcggggtgggcgtgcagaaggagggcgtcttccacaccatgtggcacgtgacccgcggggccgtgctcacgtacaacggcaagcgcctggagcccaactgggccagcgtcaagaaggacctgatctcctacgggggcgggtggcggctcagcgcccagtggcagaagggcgaggaggtccaggtgatcgcggtcgagcccggcaagaaccccaagaacttccagaccatgcccgggaccttccagaccacgaccggcgagatcggggccatcgccctggacttcaagcccggcacctccggcagccccatcatcaaccgcgaggggaaggtggtgggcctgtacgggaacggcgtcgtgaccaagaacgggggctacgtgagcggcatcgcccagacgaacgccgagccggacgggcccacccccgagctggaggaggagatgttcaagaagcggaacctcaccatcatggacctgcaccccggctccgggaagacccgcaagtacctgccggcgatcgtccgggaggccatcaagcgccggctccgcacgctgatcctggcccccacccgggtggtggccgccgagatggaggaggcgctcaagggcctgcccatccgctaccagaccaccgccaccaagtccgagcacaccgggcgggagatcgtcgacctgatgtgccacgccaccttcaccatgcgcctcctgtcccccgtgcgggtgccgaactacaacctgatcatcatggacgaggcccacttcacggaccccgccagcatcgcggcccgcggctacatctccacccgggtcggcatgggggaggccgccgcgatcttcatgaccgccacgccgcccggcacggccgacgccttcccgcagagcaacgcccccatccaggacgaggagcgcgacatccccgagcgctcctggaacagcgggaacgagtggatcaccgacttcgcgggcaagaccgtgtggttcgtgccctccatcaaggccgggaacgacatcgccaactgcctccggaagaacggcaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacgggcccgagcgcgtgatcctggcgggccccatgccggtcaccgccgccagcgccgcccagcggcgcgggcgggtgggccgcaacccccagaaggagaacgaccagtacatcttcaccgggcagcccctcaacaacgacgaggaccacgcgcactggaccgaggccaagatgctgctggacaacatcaacacccccgagggcatcatcccggccctcttcgagcccgagcgggagaagtccgccgcgatcgacggcgagtaccgcctgaagggggagagccggaagacgttcgtggagctgatgcgccggggcgacctccccgtctggctggcccacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacctacagcgacccgctggccctcaaggagttcaaggagttcgcggccgggcgcaagtccatcgccctggacctggtgacggagatcggccgggtgcccagccacctcgcccaccgcacccggaacgccctggacaacctggtcatgctccacacctccgagcacgggggccgcgcgtaccggcacgccgtggaggagctgcccgagaccatggagacgctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcggcatcctcacgctggccgccatcatcgcggccaacgagatgggcctgctcgagaccaccaagcgggacctggggatgagcaaggagccgggcgtggtgtcccccaccagctacctggacgtcgacctccaccccgcctccgcctggacgctgtacgcggtggccaccaccgtgatcacccccatgctgcgccacacgatcgagaacagcaccgccaacgtctccctcgccgccatcgcgaaccaggccgtggtgctgatggggctggacaagggctggccgatcagcaagatggacctcggggtccccctgctggccctcggctgctactcccaggtgaaccccctgaccctgaccgccgccgtgctcctgctgatcacgcactacgcgatcatcggccccgggctccaggccaaggccacccgggaggcccagaagcgcaccgccgcgggcatcatgaagaacccgaccgtcgacgggatcatgacgatcgacctggaccccgtgatctacgacagcaagttcgagaagcagctgggccaggtgatgctcctggtcctgtgcgccgtgcagctcctgctgatgcggacctcctgggccctctgcgaggccctgaccctggcgaccggccccatcacgaccctctgggaggggagccccggcaagttctggaacaccaccatcgccgtgtccatggccaacatcttccgcgggagctacctggccggcgccgggctggcgttctccatcatgaagtccgtcggcacgggcaagcgggggaccggctcccagggggagaccctcggcgagaagtggaagaagaagctgaaccagctgagccgcaaggacttcgacctctacaagaagtccgggatcaccgaggtggaccggaccgaggccaaggagggcctgaagcgcggcgagatcacgcaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacgcacgagatgtactggatcagcaacgggaccggcaacatcgtggcgtccgtcaacatggtgagccggctcctgctgaaccgcttcaccatgacccaccggcgcccgacgatcgagaaggacgtggacctcggcgccgggacccggcacgtcaacgccgagcccgagacccccaacatggacgtgatcggcgagcgcatcaagcggatcaaggaggagcacaactccacctggcactacgacgacgagaacccgtacaagacgtgggcctaccacgggagctacgaggtgaaggccaccggctccgcgagctccatgatcaacggggtcgtgaagctgctgaccaagccctgggacgtcgtgcccatggtgacccagatggccatgacggacaccacccccttcggccagcagcgcgtcttcaaggagaaggtggacacccggacgccgcgcagcatgcccggcacccggcgcgtgatggggatcaccgccgagtggctctggcggaccctgggccgcaacaagaagccccggctgtgcacgcgcgaggagttcaccaagaaggtccgcaccaacgccgcgatgggggccgtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggcgaagggcagccgcgccatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgcggacgacacggccggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcgggagcggccaggtggggacctacggcctgaacacgttcaccaacatggaggcccagctcatccggcagatggagggggagggcgtgctgctgaaggcggacctcgagaacccccacctccccgagaagaagatcacccagtggctggagaccaagggcgtcgagcgcctgaagcggatggccatctccggggacgactgcgtggtgaagcccatcgacgaccgcttcgccaacgccctgctggccctcaacgacatgggcaaggtccggaaggacatcccccagtggcagcccagcaaggggtggcacgactggcagcaggtcccgttctgctcccaccacttccacgagctgatcatgaaggacggccgcaagctggtggtcccctgccggccccaggacgagctcatcgggcgcgcgcggatcagccagggcgccggctggtccctgaaggagacggcctgcctggggaaggcctacgcgcagatgtggagcctcatgtacttccaccgccgcgacctgcggctggcctccaacgccatctgcagcgccgtgcccgtgcactgggtcccgacctcccgcaccacctggagcatccacgcccaccaccagtggatgacgaccgaggacatgctcaccgtgtggaaccgggtgtggatcgaggacaacccctggatggaggacaagacccccgtcacgacctgggagaacgtgccctacctgggcaagcgcgaggaccagtggtgcgggtccctgatcggcctcaccagccgggcgacctgggcccagaacatcccgacggccatccagcaggtccgcagcctgatcgggaacgaggagttcctggactacatgccctccatgaagcggttccgcaaggaggaggagagcgagggcgccatctggtga

SEQ ID NO: 10064 - RNA, 9873 nt, synthetic construct
  misc_feature 1..9873: note = derived and/or modified CDS sequence (opt1) from DENV-3__JF937638__SS-prME
  source 1..9873: mol_type = other RNA
accagcctgtgcctcctgatgatcctgcccgccgccctcgcgttccacctgaccagccgggacggggagccgcggatgatcgtggggaagaacgagcggggcaagagcctcctgttcaagaccgccagcgggatcaacatgtgcaccctgatcgccatggacctgggggagatgtgcgacgacaccgtgacctacaagtgcccccacatcaccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtgacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccaccctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacacggtgatcatcaccgtgcacaccggggaccagcaccaggtcggcaacgagacccagggggtgacggccgagatcacgccccaggccagcaccaccgaggcgatcctgcccgagtacggcaccctcgggctggagtgctccccgcgcacgggcctggacttcaacgagatgatcctcctgaccatgaagaacaaggcctggatggtccaccggcagtggttcttcgacctgcccctcccctggaccagcggcgccaccacggagacccccacctggaaccgcaaggagctgctggtgaccttcaagaacgcccacgccaagaagcaggaggtggtcgtgctcgggtcccaggagggcgcgatgcacacggccctgaccggggccaccgagatccagaacagcggcgggacctccatcttcgccggccacctgaagtgccggctcaagatggacaagctggagctgaagggcatgagctacgccatgtgcacgaacaccttcgtgctcaagaaggaggtctccgagacccagcacgggaccatcctgatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctcggcgacacggcctgggacttcgggtccgtgggcggggtgctgaacagcctgggcaagatggtccaccagatcttcgggtccgcgtacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggccgacatggggtgcgtcatcaactggaagggcaaggagctcaagtgcggcagcgggatcttcgtgaccaacgaggtgcacacctggaccgagcagtacaagttccaggcggactcccccaagcgcctggccacggccatcgccggcgcctgggagaacggggtctgcggcatccgcagcaccacccggatggagaacctgctctggaagcagatcgcgaacgagctgaactacatcctgtgggagaacaacatcaagctcaccgtggtggtcggggacatcatcggcgtgctggagcagggcaagcgcacgctgacgccccagccgatggagctcaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctgaagctgcgcgaggtgtacacccagctctgcgaccaccggctgatgagcgcggccgtgaaggacgagcgcgccgtccacgccgacatgggctactggatcgagagccagaagaacgggtcctggaagctggagaaggccagcctcatcgaggtgaagacgtgcacctggccgaagtcccacaccctgtggagcaacggcgtgctggagtccgacatgatcatccccaagagcctcgcggggcccatctcccagcacaaccaccggccgggctaccacacccagacggccgggccctggcacctgggcaagctggagctcgacttcaactactgcgagggcaccaccgtcgtgatcaccgagaactgcgggacgcgcggccccagcctgcggaccaccaccgtgtccgggaagctgatccacgagtggtgctgccgcagctgcacgctgccgcccctgcggtacatgggcgaggacgggtgctggtacggcatggagatccgccccatctccgagaaggaggagaacatggtcaagagcctggtgtccgccggcagcgggaaggtggacaacttcaccatgggcgtcctctgcctggccatcctgttcgaggaggtgatgcgggggaagttcggcaagaagcacatgatcgccggggtgttcttcaccttcgtcctcctgctgtccggccagatcacctggcgcgacatggcgcacacgctcatcatgatcggcagcaacgcctccgaccggatggggatgggcgtgacctacctggccctgatcgccaccttcaagatccagcccttcctcgccctggggttcttcctgcgccggctcaccagccgcgagaacctgctgctcggcgtgggcctggcgatggccacgaccctgcagctccccgaggacatcgagcagatggccaacgggatcgccctgggcctgatggcgctcaagctgatcacccagttcgagacctaccagctgtggacggccctcatcagcctgacctgctccaacaccatcttcaccctgacggtcgcctggcggaccgccaccctcatcctggccggggtgagcctgctccccgtctgccgctccagctccatgcgcaagaccgactggctgcccatggcggtggccgccatgggcgtgccgcccctgcccctcttcatcttcagcctgaaggacacgctgaagcggcgctcctggcccctcaacgagggggtcatggccgtgggcctggtgagcatcctggcctccagcctcctgcggaacgacgtccccatggcgggccccctggtggccgggggcctcctgatcgcctgctacgtgatcaccgggacctccgccgacctgaccgtcgagaaggccgcggacatcacgtgggaggaggaggccgagcagaccggcgtgagccacaacctcatgatcaccgtggacgacgacgggaccatgcgcatcaaggacgacgagaccgagaacatcctgacggtcctgctcaagaccgccctgctgatcgtgtccggcatcttcccgtacagcatccccgccaccctcctggtgtggcacacctggcagaagcagacgcagcggtccggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgcggtgctgacctacaacgggaagcgcctggagcccaactgggcctccgtcaagaaggacctcatcagctacggcgggggctggcggctgtccgcccagtggcagaagggggaggaggtccaggtgatcgccgtcgagcccggcaagaaccccaagaacttccagaccatgccgggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctcgaggaggagatgttcaagaagcggaacctgaccatcatggacctgcaccccgggagcggcaagacgcgcaagtacctcccggccatcgtccgggaggcgatcaagcgccggctgcgcaccctgatcctcgcccccacccgggtggtggccgccgagatggaggaggccctgaaggggctgcccatccgctaccagaccacggcgaccaagtccgagcacaccggccgggagatcgtcgacctcatgtgccacgccaccttcacgatgcgcctgctgagccccgtgcgggtgccgaactacaacctcatcatcatggacgaggcccacttcaccgaccccgcctccatcgccgcgcgcgggtacatcagcacccgcgtcggcatgggcgaggccgccgccatcttcatgaccgcgacgccgcccgggaccgccgacgccttcccgcagtccaacgcccccatccaggacgaggagcgggacatccccgagcgcagctggaactccggcaacgagtggatcaccgacttcgccgggaagaccgtgtggttcgtgcccagcatcaaggcgggcaacgacatcgccaactgcctgcggaagaacgggaagaaggtcatccagctgtcccgcaagacgttcgacaccgagtaccagaagaccaagctcaacgactgggacttcgtggtgaccacggacatcagcgagatgggcgccaacttcaaggccgaccgggtcatcgacccgcgccggtgcctgaagcccgtgatcctgaccgacggccccgagcgcgtgatcctcgccgggcccatgccggtcaccgcggcctccgccgcccagcggcgcggccgggtggggcgcaacccccagaaggagaacgaccagtacatcttcaccggccagcccctgaacaacgacgaggaccacgcccactggaccgaggcgaagatgctgctcgacaacatcaacacgcccgaggggatcatcccggccctgttcgagcccgagcgggagaagtccgccgccatcgacggcgagtaccgcctgaagggcgagtcccggaagaccttcgtggagctcatgcgccgcggggacctgcccgtctggctggcgcacaaggtggccagcgagggcatcaagtacaccgaccgcaagtggtgcttcgacgggcagcggaacaaccagatcctcgaggagaacatggacgtcgagatctggaccaaggagggcgagaagaagaagctgcgcccccgctggctggacgcccggacgtactccgacccgctcgccctgaaggagttcaaggagttcgccgcgggccgcaagagcatcgccctggacctcgtgaccgagatcgggcgggtgccctcccacctggcccaccgcacccggaacgccctggacaacctcgtcatgctgcacaccagcgagcacggcgggcgcgcctaccggcacgcggtggaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggccgagatcccgctgcagtggatcgccagcgcgatcgtcctcgagttcttcatgatggtgctgctgatccccgagcccgagaagcagcgcacgccccaggacaaccagctcgcctacgtggtcatcgggatcctgaccctggccgccatcatcgccgcgaacgagatgggcctcctggagaccaccaagcgggacctgggcatgtccaaggagccgggggtggtgagccccacgtcctacctcgacgtcgacctgcaccccgccagcgcctggaccctgtacgccgtggcgaccaccgtgatcacgcccatgctccgccacaccatcgagaactccaccgccaacgtcagcctggccgccatcgccaaccaggcggtggtgctgatgggcctcgacaaggggtggccgatctccaagatggacctgggcgtccccctgctcgccctggggtgctacagccaggtgaaccccctgaccctcacggccgccgtgctgctgctcatcacccactacgccatcatcggccccggcctgcaggcgaaggccacccgggaggcccagaagcgcaccgccgccgggatcatgaagaacccgacggtcgacggcatcatgaccatcgacctggaccccgtgatctacgactccaagttcgagaagcagctcggccaggtgatgctgctggtcctctgcgcggtgcagctgctgctcatgcggaccagctgggccctgtgcgaggccctgaccctcgccacgggccccatcaccaccctgtgggagggctcccccgggaagttctggaacaccacgatcgcggtgagcatggccaacatcttccgcggctcctacctggccggggccggcctcgccttcagcatcatgaagtccgtcgggaccggcaagcggggcaccgggagccagggcgagaccctgggggagaagtggaagcgcaagctgaaccagctcagccggaaggacttcgacctgtacaagaagtccggcatcaccgaggtggaccgcacggaggcgaaggaggggctgaagcggggcgagatcacccaccacgccgtgagccgcggctccgccaagctccagtggttcgtcgagcggaacatggtgaccccggaggggcgcgtgatcgacctgggctgcgggcgcggcgggtggagctactactgcgccggcctgaagaaggtcaccgaggtgcggggctacacgaagggcgggcccgggcacgaggagcccgtgcccatgtccacctacggctggaacatcgtcaagctcatgagcgggaaggacgtgttctacctgccgcccgagaagtgcgacaccctgctgtgcgacatcggcgagtccagcccctcccccaccgtggaggagagccgcacgatccgggtcctcaagatggtggagccgtggctgaagaacaaccagttctgcatcaaggtgctgaacccctacatgcccaccgtcatcgagcacctcgagcgcctgcagcggaagcacggcgggatgctggtgcgcaaccccctctcccggaacagcacccacgagatgtactggatctccaacggcaccgggaacatcgtggccagcgtcaacatggtgtcccgcctgctgctcaaccggttcacgatgacccaccgccggccgaccatcgagaaggacgtggacctgggcgcgggcacccgccacgtcaacgccgagcccgagacgcccaacatggacgtgatcggggagcggatcaagcgcatcaaggaggagcacaacctgacctggcactacgacgacgagaacccgtacaagacctgggcctaccacggcagctacgaggtgaaggccaccgggtccgccagctccatgatcaacggcgtcgtgaagctcctgacgaagccctgggacgtcgtgcccatggtgacccagatggcgatgaccgacaccacgcccttcgggcagcagcgggtcttcaaggagaaggtggacacccgcaccccgcggagcatgcccggcacccgccgggtgatgggcatcacggccgagtggctgtggcgcaccctcgggcgcaacaagaagccccggctgtgcacccgcgaggagttcaccaagaaggtccggacgaacgccgccatgggcgcggtgttcaccgaggagaaccagtgggacagcgccaaggccgccgtggaggacgaggacttctggaagctggtcgaccgcgagcgggagctccacaagctggggaagtgcggctcctgcgtgtacaacatgatggggaagcgcgagaagaagctgggcgagttcggcaaggccaaggggagccgggcgatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccgggggcgccatgtacgccgacgacaccgcggggtgggacacccggatcacggaggacgacctgcacaacgaggagaagatcacccagcagatggacccggagcaccgccagctggccaacgccatcttcaagctcacctaccagaacaaggtcgtgaaggtgcagcggcccacccccaccggcacggtcatggacatcatctcccgcaaggaccagcggggcagcggccaggtgggcacctacgggctgaacaccttcaccaacatggaggcccagatcatccgccagatggagggcgagggggtgctgtccaaggccgacctcgagaacccccacctcccggagaagaagatcacgcagtggctggagaccaagggcgtcgagcggctcaagcgcatggcgatcagcggcgacgactgcgtggtgaagcccatcgacgaccggttcgccaacgccctgctggccctcaacgacatggggaaggtccgcaaggacatcccccagtggcagccctccaagggctggcacgactggcagcaggtcccgttctgcagccaccacttccacgagctgatcatgaaggacgggcggaagctggtggtcccctgccgcccccaggacgagctcatcggccgcgcccggatctcccagggggcgggctggagcctgaaggagaccgcctgcctgggcaaggcctacgcccagatgtggtccctcatgtacttccaccgccgggacctgcgcctggcgagcaacgccatctgctccgccgtgcccgtgcactgggtcccgaccagccggacgacctggtccatccacgcccaccaccagtggatgaccaccgaggacatgctcacggtgtggaaccgcgtgtggatcgaggacaacccctggatggaggacaagacccccgtcaccacctgggagaacgtgccctacctggggaagcgggaggaccagtggtgcggcagcctgatcgggctcacgagccgcgccacctgggcgcagaacatcccgaccgccatccagcaggtccggtccctgatcggcaacgaggagttcctggactacatgcccagcatgaagcgcttccggaaggaggaggagtccgagggggccatctggtga

SEQ ID NO: 10065 - RNA, 9873 nt, synthetic construct
  misc_feature 1..9873: note = derived and/or modified CDS sequence (opt1) from DENV-3__JF937639__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgcgccgtgcaagatccccttcagcacggaggacgggcagggcaaggcccacaacggccgcctgatcaccgccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacacggcgtgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacctggatcggcctgaacagccgcaacacctccatgagcttctcctgcatcgccatcgggatcatcacgctctacctgggcgccgtcgtgcaggcggacatggggtgcgtgatcaactggaagggcaaggagctgaagtgcggcagcgggatcttcgtcaccaacgaggtgcacacctggaccgagcagtacaagttccaggccgactcccccaagcgcctcgccacggccatcgccggcgcgtgggagaacggggtgtgcggcatccggagcaccacccgcatggagaacctgctgtggaagcagatcgccaacgagctcaactacatcctgtgggagaacaacatcaagctgaccgtcgtggtgggggacatcatcggcgtcctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgtgtcccgcgcgtggaacgtctgggaggtggaggactacgggttcggcgtgttcaccaccaacatctggctcaagctgcgggaggcctacacccagctgtgcgaccaccgcctcatgagcgccgccgtcaaggacgagcgggccgtgcacgcggacatgggctactggatcgagagccagaagaacgggtcctggaagctggagaaggccagcctgatcgaggtgaagacgtgcacctggccgaagtcccacaccatctggagcaacggcgtcctcgagtccgacatgatcatccccaagagcctggccgggcccatctcccagcacaaccaccgcccgggctaccacacccagacggccgggccctggcacctgggcaagctcgagctggacttcaactactgcgagggcaccaccgtggtgatcaccgagaactgcgggacgcggggccccagcctgcgcaccaccaccgtctccgggaagctcatccacgagtggtgctgccggagctgcacgctgcccccgctgcgctacatgggcgaggacgggtgctggtacggcatggagatccggcccatctccgagaaggaggagaacatggtcaagagcctcgtgtccgccggcagcgggaaggtcgacaacttcaccatgggcgtgctgtgcctggcgatcctcttcgaggaggtgatgcgcgggaagttcggcaagaagcacatgatcgccggggtcttcctgaccttcgtgctgctcctgtccggccagatcacctggcgggacatggcccacacgctgatcatgatcggcagcaacgcctccgaccgcatggggatgggcgtgacctacctcgccctgatcgcgaccttcaagatccagcccttcctggccctcgggttcttcctgcggaagctgaccagccgcgagaacctcctgctgggcgtcggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtgagcctgctgccggtctgccagtccagctccatgcgcaagaccgactggctccccatggccgtggccgccatgggcgtgccgcccctcccgctgttcatcttcagcctcaaggacacgctgaagcgccggtcctggcccctgaacgagggggtgatggcggtgggcctcgtcagcatcctggcctccagcctgctccgcaacgacgtgcccatggccggccccctggtggccgggggcctgctcatcgcctgctacgtcatcaccgggacctccgcggacctgaccgtggagaaggccgccgacatcacgtgggaggaggaggccgagcagaccggcgtgagccacaacctgatgatcaccgtcgacgacgacgggaccatgcggatcaaggacgacgagaccgagaacatcctcacggtgctgctgaagaccgccctcctgatcgtgtccggcatcttcccgtacagcatccccgcgaccctgctcgtctggcacacctggcagaagcagacgaagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacgcgcggcgccgtcctcacctacaacgggaagcggctggagcccaactgggcctccgtgaagaaggacctgatcagctacggcgggggctggcgcctctccgcgcagtggcagaagggggaggaggtgcaggtcatcgccgtggagcccggcaagaaccccaagaacttccagaccatgcccggcaccttccagacgaccaccggggagatcggcgccatcgccctggacttcaagcccgggaccagcggcagccccatcatcaaccgggagggcaaggtggtcgggctgtacggcaacggggtggtgacgaagaacggcgggtacgtctccggcatcgcccagaccaacgcggagccggacggccccacccccgagctggaggaggagatgttcaagaagcgcaacctcaccatcatggacctgcaccccgggagcggcaagacgcggaagtacctgccggccatcgtgcgcgaggccatcaagcggcgcctccggaccctgatcctggcccccacccgcgtggtcgccgcggagatggaggaggccctcaaggggctgcccatccggtaccagaccacggccaccaagtccgagcacaccggccgcgagatcgtggacctgatgtgccacgccaccttcacgatgcggctcctgagccccgtgcgcgtcccgaactacaacctgatcatcatggacgaggcccacttcaccgaccccgcgtccatcgccgcccgggggtacatcagcacccgcgtgggcatgggcgaggccgcggccatcttcatgaccgccacgccgcccgggaccgccgacgccttcccgcagtccaacgcgcccatccaggacgaggagcgcgacatccccgagcggagctggaactccggcaacgagtggatcaccgacttcgccgggaagaccgtgtggttcgtccccagcatcaaggccggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggcggaccgcgtgatcgacccgcggcgctgcctcaagcccgtgatcctgaccgacggccccgagcgggtcatcctggccgggcccatgccggtgaccgccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccggctgaagggcgagtcccgcaagaccttcgtcgagctgatgcggcgcggggacctccccgtgtggctggcccacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtactccgacccgctggcgctcaaggagttcaaggagttcgccgccggccgcaagagcatcgccctggacctggtgaccgagatcgggcgcgtcccctcccacctcgcccaccggacccgcaacgcgctggacaacctggtgatgctccacaccagcgagcacggcgggcgggcctaccgccacgccgtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcggacgccccaggacaaccagctggcctacgtcgtgatcgggatcctcaccctggccgcgatcatcgccgccaacgagatgggcctgctcgagaccaccaagcgcgacctgggcatgtccaaggagccgggggtggtcagccccacgtcctacctggacgtggacctccaccccgccagcgcgtggaccctgtacgccgtggccaccaccgtcatcacgcccatgctgcggcacaccatcgagaactccaccgccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgacggccgcggtcctcctgctgatcacccactacgccatcatcggccccggcctccaggccaaggccacccgcgaggcccagaagcggaccgcggccgggatcatgaagaacccgacggtggacggcatcatgaccatcgacctggaccccgtgatctacgactccaagttcgagaagcagctggggcaggtcatgctcctggtgctgtgcgccgtgcagctcctgctgatgcgcaccagctgggccctctgcgaggcgctgaccctggccacgggccccatcaccaccctctgggagggctcccccgggaagttctggaacaccacgatcgccgtcagcatggccaacatcttccggggctcctacctggccggggcgggcctggccttcagcatcatgaagtccgtggggaccggcaagcgcggcaccgggagccagggcgagaccctcggggagaagtggaagaagaagctgaaccagctgagccggaaggacttcgacctctacaagaagtccggcatcaccgaggtggaccgcacggaggccaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgcgggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgggtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgccggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggcgaccgggagcgcctccagcatgatcaacggcgtggtgaagctgctgaccaagccctgggacgtcgtgcccatggtcacgcagatggccatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgcgaggagttcaccaagaaggtgcggaccaacgcggccatgggcgccgtgttcacggaggagaaccagtgggactccgccaaggccgcggtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgcgatgtacgccgacgacaccgccgggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcgcagctcatccgccagatggagggcgagggggtcctgagcaaggccgacctggagaacccccacctcccggagaagaagatcacccagtggctggagacgaagggcgtggagcggctgaagcgcatggccatctccggcgacgactgcgtggtcaagcccatcgacgaccggttcgccaacgccctcctggcgctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggccggctggtccctcaaggagaccgcctgcctgggcaaggcgtacgcccagatgtggagcctgatgtacttccaccgccgggacctccgcctggcctccaacgccatctgcagcgccgtgcccgtccactgggtgccgacctcccggaccacgtggagcatccacgcgcaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgacctcccgcgccacgtgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10066 - RNA, 9873 nt, synthetic construct
  misc_feature 1..9873: note = derived and/or modified CDS sequence (opt1) from DENV-3__JF937627__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagcgggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccggagcaccacccgcatggagaacctgctgtggaagcagatcgcgaacgagctcaactacatcctgtgggagaacaacatcaagctgaccgtggtggtcggggacatcatcggcgtgctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgtctcccgcgcctggaacgtgtgggaggtggaggactacgggttcggcgtcttcaccaccaacatctggctcaagctgcgggaggtgtacacccagctgtgcgaccaccgcctcatgagcgcggccgtgaaggacgagcgggccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgccggggtgttcttcaccttcgtcctgctcctgtccggccagatcacctggcgggacatggcgcacacgctgatcatgatcggcagcaacgcctccgaccgcatggggatgggcgtgacctacctcgccctgatcgccaccttcaagatccagcccttcctggccctcgggttcttcctgcggaagctgaccagccgcgagaacctcctgctgggcgtgggcctcgcgatggccacgaccctgcagctgcccgaggacatcgagcagatggccaacgggatcgccctcggcctgatggcgctgaagctcatcacccagttcgagatctaccagctgtggaccgccctgatcagcctcacgtgctccaacaccatcttcaccctgaccgtcgcctggcggacggccaccctgatcctcgccggggtgagcctgctgccgatgtgccagtccagctccatgcgcaagaccgactggctccccatggcggtcgccgccatgggcgtgccgcccctcccgctgttcatcttcagcctcaaggacaccctgaagcgccggtcctggcccctgaacgagggggtgatggccgtcggcctcgtgagcatcctggcctccagcctgctccgcaacgacgtgcccatggcgggccccctggtcgccgggggcctgctcatcgcctgctacgtgatcacggggacctccgccgacctgaccgtggagaaggccgcggacatcacctgggaggaggaggccgagcagacgggcgtcagccacaacctgatgatcaccgtggacgacgacgggaccatgcggatcaaggacgacgagaccgagaacatcctcaccgtgctgctgaagacggccctcctgatcgtctccggcatcttcccgtacagcatccccgccaccctgctcgtgtggcacacctggcagaagcagacccagcgctccggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgcggtgctcacgtacaacgggaagcggctggagcccaactgggcctccgtgaagaaggacctgatcagctacggcgggggctggcgcctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgggagggcaaggtcgtggggctgtacggcaacggggtggtcaccaagaacggcgggtacgtgtccggcatcgcccagacgaacgccgagccggacggccccacccccgagctggaggaggagatgttcaagaagcgcaacctcaccatcatggacctgcaccccgggagcggcaagacccggaagtacctgccggccatcgtgcgcgaggcgatcaagcggcgcctccggacgctgatcctggcccccacccgcgtcgtggccgccgagatggaggaggccctcaaggggctgcccatccggtaccagaccaccgcgacgaagtccgagcacaccggccgcgagatcgtggacctgatgtgccacgccaccttcaccatgcggctcctgagccccgtccgcgtgccgaactacaacctgatcatcatggacgaggcccacttcacggaccccgcctccatcgccgcgcgggggtacatcagcacccgcgtgggcatgggcgaggccgccgccatcttcatgaccgcgacgccgcccgggacggccgacgccttcccgcagtccaacgcccccatccaggacgaggagcgcgacatccccgagcggagctggaactccggcaacgagtggatcaccgacttcgccgggaagaccgtctggttcgtgcccagcatcaaggcgggcaacgacatcgccaactgcctccgcaagaacgggaagaaggtgatccagctgtcccggaagaccttcgacacggagtaccagaagaccaagctgaacgactgggacttcgtcgtgaccaccgacatcagcgagatgggcgccaacttcaaggccgaccgcgtgatcgacccgcggcgctgcctcaagcccgtcatcctgacggacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgcgagaagtccgccgccatcgacggcgagtaccggctgaagggcgagtcccgcaagacgttcgtggagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctactccgacccgctggccctcaaggagttcaaggagttcgccgcgggccgcaagagcatcgccctggacctggtcacggagatcgggcgcgtgccctcccacctcgcccaccggacccgcaacgccctggacaacctggtgatgctccacaccagcgagcacggcgggcgggcctaccgccacgcggtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcacgctggccgccatcatcgccgcgaacgagatgggcctgctcgagaccaccaagcgcgacctgggcatgtccaaggagccgggggtcgtgagccccacctcctacctggacgtggacctccaccccgccagcgcctggacgctgtacgccgtcgcgaccaccgtgatcacccccatgctgcggcacacgatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtcatctacgactccaagttcgagaagcagctgggccaggtgatgctcctggtgctgtgcgtcgtgcagctcctgctgatgcgcaccagctgggcgctctgcgaggccctgaccctggccaccggccccatcacgaccctctgggagggctcccccgggaagttctggaacaccaccatcgccgtgagcatggcgaacatcttccggggctcctacctggccggggccggcctggccttcagcatcatgaagtccgtcgggacgggcaagcgcggcaccgggagccagggcgagaccctcggggagaagtggaagaagaagctgaaccagctgagccggaaggacttcgacctctacaagaagtccggcatcaccgaggtggaccgcaccgaggccaaggaggggctgaagcggggcgagatcacgcaccacgcggtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgccggcacccgccacgtcaacgcggagcccgagacccccaacatggacatcatcggggagcggatcaagcgcatcaaggaggagcacaacagcacctggcactacgacgacgagaacccgtacaagacgtgggcctaccacggctcctacgaggtgaaggccaccgggagcgcctccagcatgatcaacggcgtggtcaagctgctgaccaagccctgggacgtggtccccatggtgacccagatggccatgacggacaccacccccttcgggcagcagcgggtgttcaaggagaaggtcgacacccgcacgccgcggagcatgcccggcacccgccgggtgatgggcatcaccgcggagtggctctggcgcaccctggggcggaacaagaagccccgcctgtgcacgcgcgaggagttcaccaagaaggtgcggaccaacgccgccatgggcgccgtcttcaccgaggagaaccagtgggactccgcgaaggccgccgtggaggacgaggacttctggaagctcgtgaacaaggagcgcgagctgcacaagctggggaagtgcggcagctgcgtctacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacacggccgggtgggacacccgcatcaccgaggacgacctgcacaacgaggagaagatcacccagcagatggacccggagcaccggcagctcgcgaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcccagctcatccggcagatggagggcgagggggtgctgagcaaggccgacctggagaacccccacctcccggagaagaagatcacccagtggctggagaccaagggcgtggagcgcctgaagcggatggccatctccggcgacgactgcgtcgtgaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctcaaggagacggcgtgcctgggcaaggcctacgcccagatgtggagcctgatgtacttccaccgccgcgacctccggctggcctccaacgcgatctgcagcgccgtccccgtgcactgggtgccgacctcccgcaccacctggagcatccacgcccaccaccagtggatgacgaccgaggacatgctgaccgtctggaaccgggtgtggatcgaggacaacccctggatggaggacaagacccccgtgacgacctgggagaacgtcccctacctcgggaagcgcgaggaccagtggtgcggcagcctgatcgggctgacctcccgggccacctgggcccagaacatcccgacggcgatccagcaggtccgcagcctcatcggcaacgaggagttcctggactacatgccctccatgaagcggttccgcaaggaggaggagagcgagggggccatctggtga

SEQ ID NO: 10067 - RNA, 9873 nt, synthetic construct
  misc_feature 1..9873: note = derived and/or modified CDS sequence (opt1) from DENV-3__KF973476__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatcggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgccggctgaccagccgcgagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcggaccgccaccctgatcctcgccggggtgagcctgctgccggtctgccagtccagctccatgcgcaagaccgactggctccccatggcggtggccgccatgggcgtgccgcccctcccgctgttcatcttcagcctcaaggacacgctgaagcgccggtcctggcccctgaacgagggggtcatggccgtgggcctcgtgagcatcctggcctccagcctgctccgcaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacgggaccatgcggatcaaggacgacgagaccgagaacatcctcacggtcctgctgaagaccgccctcctgatcgtgtccggcatcttcccgtacagcatccccgccaccctgctcgtgtggcacacctggcagaagcagacgcagcgctccggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgcggtgctcacctacaacgggaagcggctggagcccaactgggcctccgtcaagaaggacctgatcagctacggcgggggctggcgcctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccggggcgggaaggtggtgggcctgtacgggaacggcgtcgtgacgaagaacgggggctacgtgtccggcatcgcccagaccaacgccgagccggacgggcccacccccgagctggaggaggagatgttcaagaagcgcaacctcaccatcatggacctgcaccccggcagcgggaagacgcggaagtacctgccggccatcgtccgcgaggcgatcacccggcgcctccggaccctgatcctggcccccacccgcgtggtggccgccgagatggaggaggccctcaagggcctgcccatccggtaccagacgaccgcgaccaagtccgagcacaccgggcgcgagatcgtcgacctgatgtgccacgccacgttcaccatgcggctcctgagccccgtgcgcgtgccgaactacaacctgatcatcatggacgaggcccacttcaccgaccccgcctccatcgccgcgcggggctacatcagcacccgcgtcggcatgggggaggccgccgccatcttcatgacggcgacgccgcccggcaccgccgacgccttcccgcagtccaacgcccccatccaggacgaggagcgcgacatccccgagcggagctggaactccgggaacgagtggatcaccgacttcgccggcaagacggtgtggttcgtgcccagcatcaaggcggggaacgacatcgccaactgcctccgcaagaacggcaagaaggtcatccagctgtcccggaagaccttcgacaccgagtaccagaagaccaagctgaacgactgggacttcgtggtgacgaccgacatcagcgagatgggcgccaacttcaaggccgaccgcgtcatcgacccgcggcgctgcctcaagcccgtgatcctgaccgacgggcccgagcgggtgatcctggccggccccatgccggtcaccgcggcctccgccgcccagcgccgggggcgcgtgggccggaacccccagaaggagaacgaccagtacatcttcaccgggcagcccctcaacaacgacgaggaccacgcccactggacggaggcgaagatgctgctggacaacatcaacacccccgagggcatcatcccggccctcttcgagcccgagcgcgagaagtccgccgccgtggacggcgagtaccggctgaagggggagtcccgcaagaccttcgtcgagctgatgcggcgcggcgacctccccgtgtggctggcgcacaaggtcgccagcgaggggatcaagtacaccgaccggaagtggtgcttcgacggccagcgcaacaaccagatcctggaggagaacatggacgtggagatctggacgaaggagggcgagaagaagaagctccggccccgctggctggacgcccgcacctactccgacccgctggccctcaaggagttcaaggagttcgccgcggggcgcaagagcatcgccctggacctggtgaccgagatcggccgcgtcccctcccacctcgcccaccggacccgcaacgccctggacaacctggtgatgctccacacgagcgagcacgggggccgggcctaccgccacgcggtggaggagctgcccgagaccatggagaccctgctcctgctggggctcatgatcctgctgaccggcggcgccatgctgttcctgatcagcgggaagggcatcgggaagacgtccatcggcctgatctgcgtcatcgccagctccgggatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcggcatcctcaccctggccgccatcatcgccgcgaacgagatgggcctgctcgagaccacgaagcgcgacctggggatgtccaaggagccgggcgtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatggggctggacaagggctggccgatctccaagatggacctcggggtgcccctgctggccctcggctgctacagccaggtgaaccccctgacgctgaccgccgccgtcctcctgctgatcacccactacgccatcatcggccccgggctccaggcgaaggccacccgcgaggcccagaagcggacggccgccggcatcatgaagaacccgaccgtggacgggatcatgaccatcgacctggaccccgtgatctacgactccaagttcgagaagcagctgggccaggtcatgctcctggtgctgtgcgcggtgcagctcctgctgatgcgcaccagctgggccctctgcgaggccctgacgctggccaccggccccatcaccaccctctgggaggggtcccccggcaagttctggaacacgaccatcgcggtcagcatggccaacatcttccgggggtcctacctggccggcgccgggctggccttcagcatcatgaagtccgtgggcaccggcaagcgcgggaccggcagccagggggagaccctcggcgagaagtggaagcggaagctgaaccagctgagccgcaaggacttcgacctctacaagaagtccgggatcacggaggtggaccggaccgaggcgaaggagggcctgaagcgcggcgagatcacccaccacgccgtcagccgggggtccgccaagctgcagtggttcgtggagcgcaacatggtgatcccggagggccgggtcatcgacctcgggtgcggccgcgggggctggagctactactgcgccggcctgaagaaggtgaccgaggtgcgcgggtacacgaagggcgggcccggccacgaggagcccgtccccatgtccacctacgggtggaacatcgtgaagctgatgagcggcaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcggctccagcgcaagcacgggggcatgctggtgcggaaccccctgtcccgcaacagcacccacgagatgtactggatctccaacgggaccggcaacatcgtcgccagcgtgaacatggtgtcccggctcctgctgaaccgcttcacgatgacccaccggcgcccgaccatcgagaaggacgtcgacctcggcgcggggacccggcacgtgaacgccgagcccgagacgcccaacatggacgtgatcggcgagcgcatcaagcggatcaaggaggagcacaacagcacctggcactacgacgacgagaacccgtacaagacctgggcctaccacgggtcctacgaggtcaaggccaccggcagcgcctccagcatgatcaacggggtggtcaagctgctgacgaagccctgggacgtggtgcccatggtcacccagatggcgatgaccgacaccacgcccttcggccagcagcgcgtgttcaaggagaaggtggacacccggaccccgcgcagcatgcccggcacccggcgcgtcatggggatcacggccgagtggctctggcggaccctgggccgcaacaagaagccccgcctgtgcacccgggaggagttcaccaagaaggtgcgcacgaacgccgccatgggggcggtgttcaccgaggagaaccagtgggactccgccaaggccgccgtcgaggacgaggacttctggaagctcgtggaccgggagcgcgagctgcacaagctgggcaagtgcgggagctgcgtgtacaacatgatgggcaagcgggagaagaagctcggcgagttcgggaaggccaagggctcccgcgcgatctggtacatgtggctgggggcccggtacctggagttcgaggccctcggcttcctgaacgaggaccactggttcagccgcgagaactcctacagcggggtcgagggcgagggcctgcacaagctcgggtacatcctgcgggacatctccaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccggcacggtgatggacatcatcagccggaaggaccagcgcgggtccggccaggtggggacctacggcctgaacaccttcaccaacatggaggcccagctcatccggcagatggagggggagggcgtcctgagcaaggccgacctggagaacccctacctcccggagaagaagatcacgcagtggctggagaccaagggcgtggagcgcctgaagcggatggcgatctccggggacgactgcgtggtcaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccgcatcagccagggcgcgggctggtccctcaaggagaccgcctgcctggggaaggcctacgcccagatgtggagcctgatgtacttccaccggcgcgacctccggctggcgtccaacgccatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcggcaagcgcgaggaccagtggtgcgggagcctgatcggcctgacgtcccgggccacctgggcgcagaacatcccgaccgccatccagcaggtccgcagcctcatcgggaacgaggagttcctggactacatgccctccatgaagcggttccgcaaggaggaggagagcgagggcgccatctggtga

SEQ ID NO: 10068 - RNA, 9873 nt, synthetic construct
  misc_feature 1..9873: note = derived and/or modified CDS sequence (opt1) from DENV-3__KF973478__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgcccgaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagcacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacctcccagcccatggagctgaagtacagctggaagacctgggggaaggccaagatcgtgaccgccgagacgcagaactccagcttcatcatcgacggcccgaacacccccgagtgcccctccgtcagccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagtcccagaagaacgggagctggaagctggagaaggcctccctgatcgaggtgaagacgtgcacctggcccaagagccacaccctctggtccaacggcgtgctggagagcgacatgatcatcccgaagtccctggcggggcccatcagccagcacaaccaccggcccggctaccacacccagacggccgggccgtggcacctcggcaagctggagctggacttcaactactgcgagggcaccaccgtcgtgatcaccgagaactgcgggacgcgcggcccctccctccggaccaccaccgtgagcgggaagctgatccacgagtggtgctgccgctcctgcacgctgccgcccctccggtacatgggcgaggacgggtgctggtacggcatggagatccgcccgatcagcgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgttcttcaccttcgtcctgctcctgagcggccagatcacctggcgcgacatggcgcacacgctgatcatgatcggctccaacgccagcgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatctccctgacctgcagcaacaccatcttcaccctgacggtcgcctggcgcaccgccaccctgatcctcgccggggtgtccctgctgcccgtctgccagagctccagcatgcggaagaccgactggctcccgatggcggtggccgccatgggcgtgccgcccctccccctgttcatcttcgggctcaaggacacgctgaagcgccgctcctggccgctgaacgagggcgtcatggccgtgggcctcgtgagcatcctggcctccagcctgctccggaacgacgtccccatggcggggcccctggtggccggcgggctgctcatcgcctgctacgtgatcaccggcacctccgccgacctgaccgtcgagaaggccgcggacatcacgtgggaggaggaggccgagcagaccggggtgagccacaacctgatgatcaccgtggacgacgacggcaccatgcgcatcaaggacgacgagaccgagaacatcctcacggtcctgctgaagaccgccctcctgatcgtgtccggcatcttcccctacagcatcccggccaccctgctcgtgtggcacacctggcagaagcagacgcagcggtccggggtcctgtgggacgtgccctccccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagccgaactgggcctccgtcaagaaggacctgatcagctacgggggcgggtggcggctctccgcccagtggcagaagggcgaggaggtccaggtgatcgccgtcgagcccggcaagaaccccaagaacttccagaccatgcccgggaccttccagacgaccaccggcgagatcggggcgatcgccctggacttcaagccgggcaccagcggcagccccatcatcaaccgcgaggggaaggtggtgggcctgtacgggaacggcgtcgtgacgaagaacgggggctacgtgtccggcatcgcccagaccaacgccgagcccgacgggccgacccccgagctggaggaggagatgttcaagaagcggaacctcaccatcatggacctgcaccccggcagcgggaagacgcgcaagtacctgcccgccatcgtccgggaggcgatcaagcgccggctccgcaccctgatcctggccccgacccgggtggtggccgccgagatggaggaggccctcaagggcctgcccatccgctaccagaccacggcgaccaagtccgagcacaccgggcgggagatcgtcgacctgatgtgccacgccaccttcacgatgcgcctcctgagccccgtgcgggtgcccaactacaacctgatcatcatggacgaggcccacttcaccgacccggcctccatcgccgcgcgcggctacatcagcacccgggtcggcatgggggaggccgccgccatcttcatgaccgcgacgccgcccggcaccgccgacgccttcccccagtccaacgccccgatccaggacgaggagcgcgacatccccgagcgcagctggaactccgggaacgagtggatcaccgacttcgccggcaagaccgtgtggttcgtgcccagcatcaaggcggggaacgacatcgccaactgcctccggaagaacggcaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccccgccggtgcctcaagccggtgatcctgaccgacgggcccgagcgcgtgatcctggccggccccatgcccgtcaccgcggcctccgccgcccagcggcgcgggcgggtgggccgcaacccgcagaaggagaacgaccagtacatcttcaccgggcagcccctcaacaacgacgaggaccacgcccactggaccgaggcgaagatgctgctggacaacatcaacacgcccgagggcatcatccccgccctcttcgagccggagcgggagaagtccgccgccatcgacggcgagtaccgcctgaagggggagtcccggaagaccttcgtggagctgatgcgccggggcgacctccccgtctggctggcgcacaaggtggccagcgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtactccgaccccctggccctcaaggagttcaaggagttcgccgcggggcgcaagagcatcgccctggacctggtgaccgagatcggccgggtgccgtcccacctcgcccaccgcacccggaacgccctggacaacctggtcatgctccacaccagcgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagacctccatcggcctgatctgcgtgatcgccagctccgggatgctctggatggccgagatccccctgcagtggatcgccagcgcgatcgtcctggagttcttcatgatggtgctcctgatcccggagcccgagaagcagcgcacgccccaggacaaccagctggcctacgtggtcatcggcatcctcaccctggccgccatcatcgccgcgaacgagatgggcctgctcgagaccaccaagcgggacctggggatgtccaaggagcccggcgtggtgagcccgacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatggggctggacaagggctggcccatctccaagatggacctcggggtcccgctgctggccctcggctgctacagccaggtgaaccccctgaccctgacggccgccgtgctcctgctgatcacccactacgccatcatcggccccgggctccaggcgaaggccacccgggaggcccagaagcgcaccgccgccggcatcatgaagaaccccacggtcgacgggatcatgaccatcgacctggacccggtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggaggggtcccccggcaagttctggaacaccacgatcgcggtgagcatggccaacatcttccgcgggtcctacctggccggcgccgggctggccttcagcatcatgaagtccgtcggcaccggcaagcgggggaccggcagccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgagccgggggtccgccaagctgcagtggttcgtcgagcgcaacatggtgatccccgagggccgggtgatcgacctcgggtgcggccgcgggggctggagctactactgcgccggcctgaagaaggtcaccgaggtgcgggggtacaccaagggcgggccgggccacgaggagcccgtgcccatgtccacgtacgggtggaacatcgtcaagctgatgagcggcaaggacgtgttctacctcccgcccgagaagtgcgacaccctgctgtgcgacatcggcgagtccagcccctcccccaccgtggaggagagccgcaccatccgcgtcctgaagatggtggagccctggctcaagaacaaccagttctgcatcaaggtgctgaacccctacatgcccacggtcatcgagcacctggagcggctccagcgcaagcacgggggcatgctggtgcggaaccccctgtcccgcaacagcacccacgagatgtactggatctccaacgggaccggcaacatcgtggccagcgtcaacatggtgtcccggctcctgctgaaccgcttcaccatgacgcaccggcgccccaccatcgagaaggacgtggacctcggcgcggggacccggcacgtcaacgccgagccggagacccccaacatggacgtgatcggcgagcgcatcaagcggatcaaggaggagcacaacagcacgtggcactacgacgacgagaacccctacaagacctgggcctaccacgggtcctacgaggtgaaggccaccggcagcgcctccagcatgatcaacggggtcgtgaagctgctgaccaagccgtgggacgtcgtgcccatggtgacgcagatggcgatgaccgacaccacccccttcggccagcagcgcgtcttcaaggagaaggtggacacgcggacgccccggagcatgccgggcacccggcgcgtgatggggatcaccgccgagtggctctggcggacgctgggccgcaacaagaagccccggctgtgcacccgcgaggagttcaccaagaaggtccgcaccaacgccgccatgggggcggtgttcacggaggagaaccagtgggactccgccaaggccgccgtggaggacgaggacttctggaagctcgtcgaccgggagcgcgagctgcacaagctgggcaagtgcgggagctgcgtgtacaacatgatgggcaagcgggagaagaagctcggcgagttcgggaaggccaagggctcccgcgcgatctggtacatgtggctgggggcccggtacctggagttcgaggccctcggcttcctgaacgaggaccactggttcagccgcgagaactcctacagcggggtggagggcgagggcctgcaccggctcgggtacatcctgcgcgacatctccaagatccccggcggggccatgtacgccgacgacaccgcgggctgggacacccggatcaccgaggacgacctgcacaacgaggagaagatcacgcagcagatggaccccgagcaccgccagctcgccaacgccatcttcaagctgacctaccagaacaaggtcgtgaaggtgcagcggccgacccccaccggcaccgtcatggacatcatcagccgcaaggaccagcgggggtccggccaggtggggacgtacggcctgaacaccttcaccaacatggaggcccagctcatccgccagatggagggggagggcgtgctgagcaaggccgacctggagaacccccacctccccgagaagaagatcacccagtggctggagacgaagggcgtcgagcggctgaagcgcatggcgatctccggggacgactgcgtggtgaagccgatcgacgaccggttcgccaacgccctcctggccctgaacgacatgggcaaggtccgcaaggacatcccccagtggcagcccagcaaggggtggcacgactggcagcaggtccccttctgctcccaccacttccacgagctcatcatgaaggacggccggaagctggtggtcccgtgccgcccccaggacgagctgatcgggcgggcccgcatcagccagggcgcgggctggtccctcaaggagaccgcctgcctggggaaggcctacgcccagatgtggagcctgatgtacttccaccgccgggacctccgcctggcgtccaacgccatctgcagcgccgtgcccgtgcactgggtccccacctcccggaccacgtggagcatccacgcccaccaccagtggatgaccaccgaggacatgctgaccgtgtggaaccgcgtgtggatcgaggacaacccgtggatggaggacaagacgcccgtcaccacctgggagaacgtgccctacctcggcaagcgggaggaccagtggtgcgggagcctgatcggcctgacctcccgcgccacgtgggcgcagaacatccccaccgccatccagcaggtccggagcctcatcgggaacgaggagttcctggactacatgccgtccatgaagcgcttccggaaggaggaggagagcgagggcgccatctggtga

SEQ ID NO: 10069 - RNA, 9873 nt, synthetic construct
  misc_feature 1..9873: note = derived and/or modified CDS sequence (opt1) from DENV-3__KF973479__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacctgggcgggaccagcatcttcgccggccacctgaagtgccggctcaagatggacaagctggagctgaagggcatgtcctacgccatgtgcacgaacaccttcgtgctcaagaaggaggtcagcgagacccagcacgggaccatcctgatcaaggtggagtacaagggcgaggacgcgccgtgcaagatccccttctccacggaggacgggcagggcaaggcccacaacggccgcctgatcaccgccaaccccgtggtcaccaagaaggaggagcccgtgaacatcgaggccgagccgcccttcggggagagcaacatcgtgatcggcatcggggacaacgcgctgaagatcaactggtacaagaagggcagctccatcgggaagatgttcgaggccaccgcccggggcgcccgccggatggccatcctcggcgacacggcgtgggacttcgggagcgtcggcggggtgctgaactccctgggcaagatggtgcaccagatcttcgggagcgcctacaccgccctcttctccggcgtcagctgggtgatgaagatcggcatcggggtgctgctgacctggatcggcctcaactccaagaacaccagcatgtccttcagctgcatcgccatcgggatcatcacgctgtacctgggcgccgtcgtgcaggcggacatggggtgcgtgatcaactggaagggcaaggagctcaagtgcggctccgggatcttcgtcaccaacgaggtgcacacctggaccgagcagtacaagttccaggccgacagccccaagcgcctggccacggccatcgccggcgcgtgggagaacggggtgtgcggcatccgctccaccacccggatggagaacctgctctggaagcagatcgccaacgagctgaactacatcctgtgggagaacaacatcaagctcaccgtcgtggtgggggacatcatcggcgtcctggagcagggcaagcgcacgctgacgccccagccgatggagctcaagtacagctggaagacctgggggaaggccaagatcgtgaccgccgagacgcagaactccagcttcatcatcgacggccccaacacccccgagtgcccctccgtgagccgggcgtggaacgtctgggaggtggaggactacgggttcggcgtgttcaccaccaacatctggctgaagctgcgcgaggtctacacccagctctgcgaccaccggctgatgtccgccgccgtgaaggacgagcgcgccgtgcacgccgacatgggctactggatcgagagccagaagaacgggagctggaagctggagaaggcgtccctcatcgaggtcaagacgtgcacctggcccaagagccacaccctgtggtccaacggcgtgctggagagcgacatgatcatccccaagtccctcgccgggcccatcagccagcacaaccaccggccgggctaccacacccagacggccgggccctggcacctgggcaagctggagctcgacttcaactactgcgagggcaccaccgtggtcatcaccgagaactgcgggacgcgcggcccctccctgcggaccaccaccgtgagcgggaagctgatccacgagtggtgctgccgctcctgcacgctgccgcccctgcggtacatgggcgaggacgggtgctggtacggcatggagatccgccccatcagcgagaaggaggagaacatggtgaagtccctggtcagcgccggctccgggaaggtggacaacttcaccatgggcgtgctctgcctggccatcctgttcgaggaggtcatgcgggggaagttcggcaagaagcacatgatcgcgggggtgttcttcaccttcgtgctcctgctgagcggccagatcacctggcgcgacatggcccacacgctcatcatgatcggctccagcgcctccgaccggatggggatgggcgtcacctacctggccctgatcgccaccttcaagatccagcccttcctcgcgctggggttcttcctgcgcaagctcaccagccgggagaacctgctgctcggcgtgggcctggccatggccacgaccctgcagctccccgaggacatcgagcagatggccaacgggatcgcgctgggcctgatggccctcaagctgatcacccagttcgagacctaccagctgtggacggccctcatcagcctgacctgctccaacaccatcttcaccctgacggtggcctggcgcaccgccaccctcatcctggcgggggtcagcctgctccccgtgtgccagtccagctccatgcggaagaccgactggctgcccatggccgtcgccgccatgggcgtgccgcccctccccctgttcatcttcgggctgaaggacacgctgaagcgccgcagctggcccctcaacgagggcgtgatggccgtcggcctggtgtccatcctggcgagctccctcctgcggaacgacgtgcccatggccgggcccctggtcgccggcgggctcctgatcgcctgctacgtgatcaccggcaccagcgccgacctgaccgtggagaaggcggccgacatcacgtgggaggaggaggccgagcagaccggggtctcccacaacctcatgatcaccgtggacgacgacggcaccatgcgcatcaaggacgacgagaccgagaacatcctgacggtgctgctcaagaccgccctgctgatcgtcagcggcatcttcccgtactccatccccgccaccctcctggtgtggcacacctggcagaagcagacgcagcggagcggggtgctgtgggacgtccccagcccgcccgagacccagaaggcggagctcgaggagggcgtgtaccgcatcaagcagcaggggatcttcggcaagacccaggtgggggtcggcgtgcagaaggagggcgtgttccacaccatgtggcacgtcacgcgcggggccgtgctgacctacaacggcaagcgcctggagcccaactgggccagcgtgaagaaggacctcatctcctacgggggcgggtggcggctgagcgcccagtggcagaagggcgaggaggtccaggtgatcgcggtggagcccggcaagaaccccaagaacttccagaccatgccggggaccttccagacgaccaccggcgagatcggggccatcgccctggacttcaagcccggcacctccggcagccccatcatcaaccgcgaggggaaggtcgtgggcctgtacgggaacggcgtggtcacgaagaacgggggctacgtgagcggcatcgcccagaccaacgccgagccggacgggcccacccccgagctcgaggaggagatgttcaagaagcggaacctgaccatcatggacctgcaccccggctccgggaagacgcgcaagtacctcccggcgatcgtgcgggaggccatcaagcgccggctgcgcaccctgatcctcgcccccacccgggtcgtggccgccgagatggaggaggcgctgaagggcctgcccatccgctaccagaccacggccaccaagagcgagcacaccgggcgggagatcgtggacctcatgtgccacgccaccttcacgatgcgcctgctgtcccccgtccgggtgccgaactacaacctcatcatcatggacgaggcccacttcaccgaccccgccagcatcgcggcccgcggctacatctccacccgggtgggcatgggggaggccgccgcgatcttcatgaccgccacgccgcccggcaccgccgacgccttcccgcagagcaacgcccccatccaggacgaggagcgcgacatccccgagcgctcctggaacagcgggaacgagtggatcaccgacttcgcgggcaagaccgtctggttcgtgccctccatcaaggccgggaacgacatcgccaactgcctgcggaagaacggcaagaaggtgatccagctgagccgcaagacgttcgacaccgagtaccagaagaccaagctcaacgactgggacttcgtcgtgaccacggacatctccgagatgggcgccaacttcaaggccgaccgggtgatcgacccgcgccggtgcctgaagcccgtcatcctgaccgacgggcccgagcgcgtgatcctcgcgggccccatgccggtgaccgccgccagcgccgcccagcggcgcgggcgggtcggccgcaacccccagaaggagaacgaccagtacatcttcaccgggcagcccctgaacaacgacgaggaccacgcgcactggaccgaggccaagatgctgctcgacaacatcaacacgcccgagggcatcatcccggccctgttcgagcccgagcgggagaagtccgccgcgatcgacggcgagtaccgcctgaagggggagagccggaagaccttcgtggagctcatgcgccggggcgacctgcccgtgtggctggcccacaaggtcgcctccgaggggatcaagtacaccgaccgcaagtggtgcttcgacggccagcggaacaaccagatcctcgaggagaacatggacgtggagatctggaccaaggagggcgagaagaagaagctgcgcccccggtggctggacgcccgcacgtacagcgacccgctcgccctgaaggagttcaaggagttcgcggccgggcgcaagtccatcgccctggacctcgtcaccgagatcggccgggtgcccagccacctggcccaccgcacccggaacgccctggacaacctcgtgatgctgcacacctccgagcacgggggccgcgcgtaccggcacgccgtcgaggagctgcccgagacgatggagaccctcctgctgctcgggctgatgatcctgctcaccggcggcgccatgctgttcctgatcagcgggaagggcatcgggaagaccagcatcggcctcatctgcgtgatcgcctccagcgggatgctgtggatggccgagatcccgctgcagtggatcgcgtccgccatcgtgctcgagttcttcatgatggtcctgctgatccccgagcccgagaagcagcgcacgccccaggacaaccagctcgcctacgtggtgatcggcatcctgaccctggccgccatcatcgcggccaacgagatgggcctcctggagaccaccaagcgggacctggggatgagcaaggagccgggcgtcgtgtcccccacgagctacctcgacgtggacctgcaccccgcctccgcctggaccctgtacgcggtcgccaccaccgtgatcacgcccatgctccgccacaccatcgagaacagcaccgccaacgtgtccctggccgccatcgcgaaccaggccgtcgtgctgatggggctcgacaagggctggccgatcagcaagatggacctgggggtgcccctgctcgccctgggctgctactcccaggtcaaccccctgaccctcacggccgccgtgctgctgctcatcacccactacgcgatcatcggccccgggctgcaggccaaggccacccgggaggcccagaagcgcaccgccgcgggcatcatgaagaacccgacggtggacgggatcatgaccatcgacctggaccccgtcatctacgacagcaagttcgagaagcagctcggccaggtgatgctgctggtgctctgcgccgtccagctgctgctcatgcggacctcctgggccctgtgcgaggccctgaccctcgcgacgggccccatcaccaccctgtgggaggggagccccggcaagttctggaacaccacgatcgccgtgtccatggccaacatcttccgcgggagctacctggccggcgccgggctcgcgttctccatcatgaagtccgtgggcaccggcaagcgggggaccggctcccagggggagaccctgggcgagaagtggaagaagaagctgaaccagctcagccgcaaggacttcgacctgtacaagaagtccgggatcaccgaggtcgaccggacggaggccaaggagggcctgaagcgcggcgagatcacccaccacgccgtgtcccgggggagcgccaagctccagtggttcgtggagcgcaacatggtcatcccggagggccgggtgatcgacctggggtgcggccgcgggggctggtcctactactgcgccggcctgaagaaggtgaccgaggtccgggggtacaccaagggcgggcccggccacgaggagcccgtgcccatgagcacgtacgggtggaacatcgtgaagctcatgtccggcaaggacgtcttctacctgccgcccgagaagtgcgacaccctgctgtgcgacatcggcgagagctcccccagccccaccgtggaggagtcccgcaccatccgcgtgctcaagatggtcgagccgtggctgaagaacaaccagttctgcatcaaggtgctgaacccctacatgcccacggtgatcgagcacctcgagcggctgcagcgcaagcacgggggcatgctggtccggaaccccctcagccgcaactccacccacgagatgtactggatcagcaacgggaccggcaacatcgtggcgtccgtgaacatggtcagccggctgctgctcaaccgcttcaccatgacgcaccggcgcccgaccatcgagaaggacgtggacctgggcgccgggacccggcacgtgaacgccgagcccgagacccccaacatggacgtcatcggcgagcgcatcaagcggatcaaggaggagcacaactccacgtggcactacgacgacgagaacccgtacaagacctgggcctaccacgggagctacgaggtgaaggccaccggctccgcgagctccatgatcaacggggtggtcaagctgctcaccaagccctgggacgtggtccccatggtgacgcagatggccatgaccgacaccacccccttcggccagcagcgcgtgttcaaggagaaggtcgacacgcggaccccgcgcagcatgcccggcacccggcgcgtgatggggatcaccgccgagtggctgtggcggacgctgggccgcaacaagaagccccggctctgcacccgcgaggagttcaccaagaaggtgcgcaccaacgccgcgatgggggccgtcttcacggaggagaaccagtgggacagcgccaaggccgccgtggaggacgaggacttctggaagctggtggaccgggagcgcgagctgcacaagctcggcaagtgcgggtcctgcgtctacaacatgatgggcaagcgggagaagaagctgggcgagttcgggaaggcgaagggcagccgcgccatctggtacatgtggctgggggcccggtacctcgagttcgaggccctgggcttcctgaacgaggaccactggttctcccgcgagaacagctactccggggtggagggcgagggcctccacaagctggggtacatcctgcgggacatcagcaagatccccggcggggccatgtacgcggacgacaccgccggctgggacacccgcatcaccgaggacgacctccacaacgaggagaagatcacgcagcagatggacccggagcaccggcagctggccaacgccatcttcaagctgacctaccagaacaaggtggtcaaggtgcagcgccccacccccaccggcaccgtgatggacatcatctcccggaaggaccagcgcgggagcggccaggtcgggacgtacggcctcaacaccttcaccaacatggaggcccagctgatccggcagatggagggggagggcgtgctgtccaaggcggacctcgagaacccccacctcccggagaagaagatcacccagtggctggagacgaagggcgtggagcgcctcaagcggatggccatcagcggggacgactgcgtcgtgaagcccatcgacgaccgcttcgccaacgccctgctggccctcaacgacatgggcaaggtgcggaaggacatcccccagtggcagccctccaaggggtggcacgactggcagcaggtcccgttctgcagccaccacttccacgagctgatcatgaaggacggccgcaagctggtggtgccctgccggccccaggacgagctcatcgggcgcgcgcggatctcccagggcgccggctggagcctgaaggagaccgcctgcctggggaaggcctacgcgcagatgtggtccctcatgtacttccaccgccgcgacctgcggctggccagcaacgccatctgctccgccgtccccgtgcactgggtgccgaccagccgcaccacgtggtccatccacgcccaccaccagtggatgaccaccgaggacatgctcaccgtctggaaccgggtgtggatcgaggacaacccctggatggaggacaagacgcccgtgaccacctgggagaacgtcccctacctgggcaagcgcgaggaccagtggtgcgggagcctgatcggcctcaccagccgggcgacgtgggcccagaacatcccgaccgccatccagcaggtccgctccctgatcgggaacgaggagttcctggactacatgcccagcatgaagcggttccgcaaggaggaggagtccgagggcgccatctggtga

SEQ ID NO: 10070 - RNA, 9873 nt, synthetic construct
  misc_feature 1..9873: note = derived and/or modified CDS sequence (opt1) from DENV-3__KF973480__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcacgctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccaccctgccggaggagcaggaccagaactacgtgtgcaagcacacctacgtcgaccgggggtggggcaacgggtgcggcctcttcgggaagggctccctggtgacgtgcgccaagttccagtgcctggagcccatcgagggcaaggtggtccagtacgagaacctcaagtacaccgtgatcatcaccgtgcacaccggggaccagcaccaggtcggcaacgagacgcagggggtgaccgccgagatcacgccccaggccagcaccaccgaggcgatcctgcccgagtacggcacgctggggctcgagtgctccccgcgcaccggcctggacttcaacgagatgatcctgctcaccatgaagaacaaggcctggatggtccaccggcagtggttcttcgacctgcccctgccctggaccagcggcgccacgaccgagacccccacctggaaccgcaaggagctcctggtgacgttcaagaacgcccacgccaagaagcaggaggtggtcgtgctggggtcccaggagggcgcgatgcacaccgccctcaccggggccaccgagatccagaacagcggcgggacgtccatcttcgccggccacctgaagtgccggctgaagatggacaagctcgagctgaagggcatgagctacgccatgtgcaccaacaccttcgtgctgaagaaggaggtctccgagacccagcacgggacgatcctcatcaaggtggagtacaagggcgaggacgtgccgtgcaagatccccttcagcaccgaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatcttcgaggcgacggcccggggcgcccgccggatggccatcctgggcgacaccgcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggccgacatggggtgcgtcatcaactggaagggcaaggagctgaagtgcggcagcgggatcttcgtgaccaacgaggtgcacacctggacggagcagtacaagttccaggcggactcccccaagcgcctcgccaccgccatcgccggcgcctgggagaacggggtctgcggcatccgcagcaccacccggatggagaacctgctgtggaagcagatcgcgaacgagctcaactacatcctgtgggagaacaacatcaagctgacggtggtggtcggggacatcatcggcgtgctcgagcagggcaagcgcaccctgacgccccagccgatggagctgaagtactcctggaagacctgggggaaggccaagatcgtgacggccgagacccagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacgcagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacctgcacctggccgaagtcccacaccctctggagcaacggcgtgctggagtccgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgcgctgctcctgtccggccagatcacgtggcgcgacatggcccacaccctgatcatgatcggcagcaacgcctccgaccggatggggatgggcgtcacctacctcgccctgatcgccaccttcaagatccagcccttcctggcgctcgggttcttcctgcgcaagctgacgagccgggagaacctcctgctgggcgtgggcctcgccatggccaccaccctgcagctgcccgaggacatcgagcagatggccaacgggatcgcgctcggcctgatggccctgaagctcatcacccagttcgagacgtaccagctgtggaccgccctgatcagcctgacctgctccaacaccatcttcacgctgaccgtggcctggcgcaccgccaccctgatcctcgcgggggtcagcctgctgccggtgtgccagtccagctccatgcggaagacggactggctccccatggccgtcgccgccatgggcgtgccgcccctcccgctgttcatcttcgggctcaaggacaccctgaagcgccgcagctggcccctgaacgagggcgtgatggccgtcggcctcgtgtccatcctggcgagctccctgctccggaacgacgtgcccatggccgggcccctggtcgccggcgggctgctcatcgcctgctacgtgatcaccggcaccagcgccgacctgacggtggagaaggcggccgacatcacctgggaggaggaggccgagcagaccggggtctcccacaacctgatgatcaccgtggacgacgacggcaccatgcgcatcaaggacgacgagacggagaacatcctcaccgtgctgctgaagaccgccctcctgatcgtcagcggcatcttcccgtactccatccccgccaccctgctcgtgtggcacacgtggcagaagcagacccagcggagcggggtgctgtgggacgtccccagcccgcccgagacccagaaggcggagctggaggagggcgtgtaccgcatcaagcagcaggggatcttcggcaagacccaggtgggggtcggcgtgcagaaggagggcgtgttccacacgatgtggcacgtcacccgcggggccgtgctcacctacaacggcaagcgcctggagcccaactgggccagcgtgaagaaggacctgatctcctacgggggcgggtggcggctcagcgcccagtggcagaagggcgaggaggtccaggtgatcgcggtggagcccggcaagaaccccaagaacttccagaccatgcccgggacgttccagaccaccaccggcgagatcggggccatcgccctggacttcaagcccggcacgtccggcagccccatcatcaaccgcgaggggaaggtcgtgggcctgtacgggaacggcgtggtcaccaagaacgggggctacgtgagcggcatcgcccagaccaacgccgagccggacgggcccacccccgagctggaggaggagatgttcaagaagcggaacctcacgatcatggacctgcaccccggctccgggaagacccgcaagtacctgccggcgatcgtgcgggaggccatcaagcgccggctccgcaccctgatcctggcccccacccgggtcgtggccgccgagatggaggaggcgctcaagggcctgcccatccgctaccagacgaccgccaccaagagcgagcacaccgggcgggagatcgtggacctgatgtgccacgccacgttcaccatgcgcctcctgtcccccgtccgggtgccgaactacaacctgatcatcatggacgaggcccacttcaccgaccccgccagcatcgcggcccgcggctacatctccacccgggtgggcatgggggaggccgccgcgatcttcatgacggccacgccgcccggcaccgccgacgccttcccgcagagcaacgcccccatccaggacgaggagcgcgacatccccgagcgctcctggaacagcgggaacgagtggatcaccgacttcgcgggcaagacggtctggttcgtgccctccatcaaggccgggaacgacatcgccaactgcctccggaagaacggcaagaaggtgatccagctgagccgcaagaccttcgacaccgagtaccagaagaccaagctgaacgactgggacttcgtcgtgacgaccgacatctccgagatgggcgccaacttcaaggccgaccgggtgatcgacccgcgccggtgcctcaagcccgtcatcctgaccgacgggcccgagcgcgtgatcctggcgggccccatgccggtgaccgccgccagcgccgcccagcggcgcgggcgggtcggccgcaacccccagaaggagaacgaccagtacatcttcaccgggcagcccctcaacaacgacgaggaccacgcgcactggacggaggccaagatgctgctggacaacatcaacacccccgagggcatcatcccggccctcttcgagcccgagcgggagaagtccgccgcgatcgacggcgagtaccgcctgaagggggagagccggaagaccttcgtggagctgatgcgccggggcgacctccccgtgtggctggcccacaaggtcgcctccgaggggatcaagtacaccgaccgcaagtggtgcttcgacggccagcggaacaaccagatcctggaggagaacatggacgtggagatctggacgaaggagggcgagaagaagaagctccgcccccggtggctggacgcccgcacctacagcgacccgctggccctcaaggagttcaaggagttcgcggccgggcgcaagtccatcgccctggacctggtcaccgagatcggccgggtgcccagccacctcgcccaccgcacccggaacgccctggacaacctggtgatgctccacacgtccgagcacgggggccgcgcgtaccggcacgccgtcgaggagctgcccgagaccatggagaccctgctcctgctggggctcatgatcctgctgaccggcggcgccatgctgttcctgatcagcgggaagggcatcgggaagacgagcatcggcctgatctgcgtgatcgcctccagcgggatgctctggatggccgagatcccgctgcagtggatcgcgtccgccatcgtgctggagttcttcatgatggtcctcctgatccccgagcccgagaagcagcgcacgccccaggacaaccagctggcctacgtggtgatcggcatcctcaccctggccgccatcatcgcggccaacgagatgggcctgctcgagaccacgaagcgggacctggggatgagcaaggagccgggcgtcgtgtcccccaccagctacctggacgtggacctccaccccgcctccgcctggaccctgtacgcggtcgccaccacggtgatcacccccatgctgcgccacaccatcgagaacagcaccgccaacgtgtccctcgccgccatcgcgaaccaggccgtcgtgctgatggggctggacaagggctggccgatcagcaagatggacctcggggtgcccctgctggccctcggctgctactcccaggtcaaccccctgacgctgaccgccgccgtgctcctgctgatcacccactacgcgatcatcggccccgggctccaggccaaggccacccgggaggcccagaagcgcacggccgcgggcatcatgaagaacccgaccgtggacgggatcatgaccatcgacctggaccccgtcatctacgacagcaagttcgagaagcagctgggccaggtgatgctcctggtgctgtgcgccgtccagctcctgctgatgcggacctcctgggccctctgcgaggccctgacgctggcgaccggccccatcaccaccctctgggaggggagccccggcaagttctggaacacgaccatcgccgtgtccatggccaacatcttccgcgggagctacctggccggcgccgggctggcgttctccatcatgaagtccgtgggcaccggcaagcgggggaccggctcccagggggagaccctcggcgagaagtggaagaagaagctgaaccagctgagccgcaaggacttcgacctctacaagaagtccgggatcacggaggtcgaccggaccgaggccaaggagggcctgaagcgcggcgagatcacccaccacgccgtgtcccgggggagcgccaagctgcagtggttcgtggagcgcaacatggtcatcccggagggccgggtgatcgacctcgggtgcggccgcgggggctggtcctactactgcgccggcctgaagaaggtgaccgaggtccgggggtacacgaagggcgggcccggccacgaggagcccgtgcccatgagcacctacgggtggaacatcgtgaagctgatgtccggcaaggacgtcttctacctcccgcccgagaagtgcgacaccctgctgtgcgacatcggcgagagctcccccagccccaccgtggaggagtcccgcacgatccgcgtgctgaagatggtcgagccgtggctcaagaacaaccagttctgcatcaaggtgctgaacccctacatgcccaccgtgatcgagcacctggagcggctccagcgcaagcacgggggcatgctggtccggaaccccctgagccgcaactccacccacgagatgtactggatcagcaacgggaccggcaacatcgtggcgtccgtgaacatggtcagccggctcctgctgaaccgcttcacgatgacccaccggcgcccgaccatcgagaaggacgtggacctcggcgccgggacccggcacgtgaacgccgagcccgagacgcccaacatggacgtcatcggcgagcgcatcaagcggatcaaggaggagcacaactccacctggcactacgacgacgagaacccgtacaagacctgggcctaccacgggagctacgaggtgaaggccaccggctccgcgagctccatgatcaacggggtggtcaagctgctgacgaagccctgggacgtggtccccatggtgacccagatggccatgaccgacaccacgcccttcggccagcagcgcgtgttcaaggagaaggtcgacacccggaccccgcgcagcatgcccggcacccggcgcgtgatggggatcacggccgagtggctctggcggaccctgggccgcaacaagaagccccggctgtgcacccgcgaggagttcaccaagaaggtgcgcacgaacgccgcgatgggggccgtcttcaccgaggagaaccagtgggacagcgccaaggccgccgtggaggacgaggacttctggaagctcgtggaccgggagcgcgagctgcacaagctgggcaagtgcgggtcctgcgtctacaacatgatgggcaagcgggagaagaagctcggcgagttcgggaaggcgaagggcagccgcgccatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgcggacgacaccgccggctgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccggcacggtgatggacatcatctcccggaaggaccagcgcgggagcggccaggtcgggacctacggcctgaacaccttcaccaacatggaggcccagctcatccggcagatggagggggagggcgtgctgtccaaggcggacctggagaacccccacctcccggagaagaagatcacgcagtggctggagaccaagggcgtggagcgcctgaagcggatggccatcagcggggacgactgcgtcgtgaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtggtgccctgccggccccaggacgagctgatcgggcgcgcgcggatctcccagggcgccggctggagcctcaaggagaccgcctgcctggggaaggcctacgcgcagatgtggtccctgatgtacttccaccgccgcgacctccggctggccagcaacgccatctgctccgccgtccccgtgcactgggtgccgaccagccgcacgacctggtccatccacgcccaccaccagtggatgaccaccgaggacatgctgacggtctggaaccgggtgtggatcgaggacaacccctggatggaggacaagacccccgtgaccacctgggagaacgtcccctacctcggcaagcgcgaggaccagtggtgcgggagcctgatcggcctgacgagccgggcgacctgggcccagaacatcccgaccgccatccagcaggtccgctccctcatcgggaacgaggagttcctggactacatgcccagcatgaagcggttccgcaaggaggaggagtccgagggcgccatctggtga

SEQ ID NO: 10071 - RNA, 9873 nt, synthetic construct
  misc_feature 1..9873: note = derived and/or modified CDS sequence (opt1) from DENV-3__KF973481__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacgatcatcatcaccgtgcacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtcaccttcaagaacgcccacgccaagaagcaggaggtggtggtcctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtgtccgagacccagcacgggaccatcctcatcaaggtcgagtacaagggcgaggacgtgccgtgcaagatccccttcagcacggaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtcggcggggtgctcaacagcctgggcaagatggtgcaccagatcttcgggtccgcgtacaccgccctgttcagcggcgtctcctgggtgatgaagatcggcatcggggtgctcctgacctggatcggcctgaacagcaagaacacctccatgagcttctcctgcatcgccatcgggatcatcacgctctacctgggcgccgtcgtgcaggccgacatggggtgcgtgatcaactggaagggcaaggagctgaagtgcggcagcgggatcttcgtcaccaacgaggtgcacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtcgtggtgggggacatcatcggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtgtcccgggcctggaacgtctgggaggtggaggactacgggttcggcgtgttcaccaccaacatctggctcaagctgcgcgaggtctacacccagctgtgcgaccaccggctcatgagcgcggccgtgaaggacgagcgcgccgtgcacgccgacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccgtgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcaccatgacgcaccggcgcccgaccatcgagaaggacgtggacctcggcgcggggacccggcacgtcaacgccgagcccgagacccccaacatggacgtgatcggcgagcgcatcaagcggatcaaggaggagcacaactccacgtggcactacgacgacgagaacccgtacaagacctgggcctaccacgggagctacgaggtgaaggccaccggctccgccagctccatgatcaacggggtcgtgaagctgctgaccaagccctgggacgtcgtgcccatggtgacgcagatggcgatgaccgacaccacccccttcggccagcagcgcgtcttcaaggagaaggtggacacgcggaccccgcgcagcatgcccggcacccggcgcgtgatggggatcaccgccgagtggctctggcggacgctgggccgcaacaagaagccccggctgtgcacccgcgaggagttcaccaagaaggtccgcaccaacgccgccatgggggcggtgttcacggaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatctcccggaaggaccagcgcgggagcggccaggtggggacgtacggcctgaacaccttcaccaacatggaggcccagctcatccggcagatggagggggagggcgtgctgtccaaggccgacctggagaacccccacctcccggagaagaagatcacccagtggctggagacgaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtgcactgggtcccgaccagccgcaccacgtggtccatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgaccagccgggccacgtgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10072 - RNA, 9873 nt, synthetic construct
  misc_feature 1..9873: note = derived and/or modified CDS sequence (opt1) from DENV-3__KF973482__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacgatcatcatcaccgtgcacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtcaccttcaagaacgcccacgccaagaagcaggaggtggtggtcctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtgtccgagacccagcacgggaccatcctcatcaaggtcgagtacaagggcgaggacgtgccgtgcaagatccccttcagcacggaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtcggcggggtgctcaacagcctgggcaagatggtgcaccagatcttcgggtccgcgtacaccgccctgttcagcggcgtctcctgggtgatgaagatcggcatcggggtgctcctgacctggatcggcctgaacagcaagaacacctccatgagcttctcctgcatcgccatcgggatcatcacgctctacctgggcgccgtcgtgcaggccgacatggggtgcgtgatcaactggaagggcaaggagctgaagtgcggcagcgggatcttcgtcaccaacgaggtgcacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtcgtggtgggggacatcatcggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtgtcccgggcctggaacgtctgggaggtggaggactacgggttcggcgtgttcaccaccaacatctggctcaagctgcgcgaggtctacacccagctgtgcgaccaccggctcatgagcgcggccgtgaaggacgagcgcgccgtgcacgccgacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccgtgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggcggtgctcacctacaacggcaagcgcctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggtccccctgctggccctcggctgctactcccaggtgaaccccctgaccctgacggccgccgtgctcctgctgatcacccactacgccatcatcggccccgggctccaggcgaaggccacccgggaggcccagaagcgcaccgccgccggcatcatgaagaacccgacggtcgacgggatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgaccctggccacgggccccatcaccaccctctgggaggggagccccggcaagttctggaacaccacgatcgcggtgtccatggccaacatcttccgcgggagctacctggccggcgccgggctggccttctccatcatgaagtccgtcggcaccggcaagcgggggaccggctcccagggggagaccctcggcgagaagtggaagaagaagctgaaccagctgagccgcaaggacttcgacctctacaagaagtccgggatcaccgaggtggaccggacggaggcgaaggagggcctgaagcgcggcgagatcacccaccacgccgtgtcccgggggagcgccaagctgcagtggttcgtcgagcgcaacatggtgatcccggagggccgggtgatcgacctcgggtgcggccgcgggggctggtcctactactgcgccggcctgaagaaggtcaccgaggtgcgggggtacaccaagggcgggcccggccacgaggagcccgtgcccatgagcacgtacgggtggaacatcgtcaagctgatgtccggcaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacgggggcatgctggtgcggaaccccctgagccgcaactccacccacgagatgtactggatcagcaacgggaccggcaacatcgtggcctccgtcaacatggtgagccggctcctgctgaaccgcttcaccatgacgcaccggcgcccgaccatcgagaaggacgtggacctcggcgcggggacccggcacgtcaacgccgagcccgagacccccaacatggacgtgatcggcgagcgcatcaagcggatcaaggaggagcacaactccacgtggcactacgacgacgagaacccgtacaagacctgggcctaccacgggagctacgaggtgaaggccaccggctccgccagctccatgaccaacggggtcgtgaagctgctgacgaagccctgggacgtcgtgcccatggtgacccagatggcgatgaccgacaccacgcccttcggccagcagcgcgtcttcaaggagaaggtggacacccggaccccgcgcagcatgcccggcacccggcgcgtgatggggatcacggccgagtggctctggcggaccctgggccgcaacaagaagccccggctgtgcacccgcgaggagttcaccaagaaggtccgcacgaacgccgccatgggggcggtgttcaccgaggagaaccagtgggacagcgccaaggccgccgtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtcgtgaaggtgcagcgccccacccccaccggcacggtcatggacatcatctcccggaaggaccagcgcgggagcggccaggtggggacctacggcctgaacaccttcaccaacatggaggcccagctcatccggcagatggagggggagggcgtgctgtccaaggccgacctggagaacccccacctcccggagaagaagatcacgcagtggctggagaccaagggcgtcgagcgcctgaagcggatggcgatcagcggggacgactgcgtggtgaagcccatcgacgaccgcttcgccaacgccctcctggccctgaacgacatgggcaaggtccggaaggacatcccccagtggcagccctccaaggggtggcacgactggcagcaggtcccgttctgcagccaccacttccacgagctcatcatgaaggacggccgcaagctggtggtcccctgccggccccaggacgagctgatcgggcgcgcccggatctcccagggcgcgggctggagcctcaaggagaccgcctgcctggggaaggcctacgcccagatgtggtccctgatgtacttccaccgccgcgacctccggctggcgagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcggcaagcgcgaggaccagtggtgcgggagcctgatcggcctgacgagccgggccacctgggcgcagaacatcccgaccgccatccagcaggtccgctccctcatcgggaacgaggagttcctggactacatgcccagcatgaagcggttccgcaaggaggaggagtccgagggcgccatctggtga

SEQ ID NO: 10073 - RNA, 9873 nt, synthetic construct
  misc_feature 1..9873: note = derived and/or modified CDS sequence (opt1) from DENV-3__KF973483__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgcgccgtgcaagatccccttcagcacggaggacgggcagggcaaggcccacaacggccgcctgatcaccgccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacacggcgtgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacctggatcggcctgaacagccgcaacacctccatgagcttctcctgcatcgccatcgggatcatcacgctctacctgggcgccgtcgtgcaggcggacatggggtgcgtgatcaactggaagggcaaggagctgaagtgcggcagcgggatcttcgtcaccaacgaggtgcacacctggaccgagcagtacaagttccaggccgactcccccaagcgcctcgccacggccatcgtgggcgcctgggagaacggggtctgcggcatccggagcaccacccgcatggagaacctgctgtggaagcagatcgcgaacgagctcaactacatcctgtgggagaacaacatcaagctgaccgtggtggtcggggacatcatcggcgtgctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgtctcccgcgcctggaacgtgtgggaggtggaggactacgggttcggcgtcttcaccaccaacatctggctcaagctgcgggagacctacacgcagctgtgcgaccaccgcctcatgagcgcggccgtgaaggacgagcgggccgtgcacgccgacatgggctactggatcgagagccagaagaacgggtcctggaagctggagaaggccagcctgatcgaggtcaagacctgcacctggccgaagtcccacaccatctggagcaacggcgtgctcgagtccgacatgatcatccccaagagcctggcggggcccatctcccagcacaaccaccgcccgggctaccacacgcagaccgccgggccctggcacctgggcaagctcgagctggacttcaactactgcgagggcaccaccgtggtcatcacggagaactgcgggacccggggccccagcctgcgcaccaccacggtgtccgggaagctcatccacgagtggtgctgccggagctgcaccctgcccccgctgcgctacatgggcgaggacgggtgctggtacggcatggagatccggcccatctccgagaaggaggagaacatggtcaagagcctcgtctccgccggcagcgggaaggtggacaacttcaccatgggcgtgctgtgcctggccatcctcttcgaggaggtcatgcgcgggaagttcggcaagaagcacatgatcgccggggtgttcctgaccttcgtgctgctcctgtccggccagatcacgtggcgggacatggcgcacaccctgatcatgatcggcagcaacgcctccgaccgcatggggatgggcgtcacctacctcgccctgatcgccaccttcaagatccagcccttcctggccctcgggttcttcctgcggaagctgacgagccgcgagaacctcctgctgggcgtgggcctcgcgatggccaccaccctgcagctgcccgaggacatcgagcagatggccaacgggatcgccctcggcctgatggcgctgaagctcatcacccagttcgagacgtaccagctgtggaccgccctgatcagcctgacctgctccaacaccatcttcacgctgaccgtggcctggcggaccgccaccctgatcctcgccggggtcagcctgctgccggtgtgccagtccagctccatgcgcaagacggactggctccccatggcggtcgccgccatgggcgtgccgcccctcccgctgttcatcttcagcctcaaggacaccctgaagcgccggtcctggcccctgaacgagggggtgatggccgtcggcctcgtgagcatcctggcctccagcctgctccgcaacgacgtgcccatggcgggccccctggtcgccgggggcctgctcatcgcctgctacgtgatcaccgggacctccgccgacctgacggtggagaaggccgcggacatcacctgggaggaggaggccgagcagaccggcgtcagccacaacctgatgatcaccgtggacgacgacgggaccatgcggatcaaggacgacgagacggagaacatcctcaccgtgctgctgaagaccgccctcctgatcgtctccggcatcttcccgtacagcatccccgccaccctgctcgtgtggcacacgtggcagaagcagacccagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacacgatgtggcacgtcacccgcggcgcggtgctcacctacaacgggaagcggctggagcccaactgggcctccgtgaagaaggacctgatcagctacggcgggggctggcgcctctccgcccagtggcagaagggggaggaggtccaggtgatcgccgtggagcccggcaagaaccccaagaacttccagaccatgcccggcacgttccagaccaccaccggggagatcggcgcgatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggccatcgtgcgcgaggcgatcaagcggcgcctccggaccctgatcctggcccccacccgcgtcgtggccgccgagatggaggaggccctcaaggggctgcccatccggtaccagacgaccgcgaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgccgcgcgggggtacatcagcacccgcgtgggcatgggcgaggccgccgccatcttcatgacggcgacgccgcccgggaccgccgacgccttcccgcagtccaacgcccccatccaggacgaggagcgcgacatccccgagcggagctggaactccggcaacgagtggatcaccgacttcgccgggaagacggtctggttcgtgcccagcatcaaggcgggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtggagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggagttcgccgcgggccgcaagagcatcgccctggacctggtcaccgagatcgggcgcgtgccctcccacctcgcccaccggacccgcaacgccctggacaacctggtgatgctccacacgagcgagcacggcgggcgggcctaccgccacgcggtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccacgaagcgcgacctgggcatgtccaaggagccgggggtcgtgagccccacctcctacctggacgtggacctccaccccgccagcgcctggaccctgtacgccgtcgcgaccacggtgatcacccccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgccatcatcggccccggcctccaggcgaaggccacccgcgaggcccagaagcggacggccgccgggatcatgaagaacccgaccgtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggacttcgacctctacaagaagtccggcatcacggaggtcgaccgcaccgaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcacgatgacccaccgccggccgaccatcgagaaggacgtggacctcggcgcgggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtggtcaagctgctgacgaagccctgggacgtggtccccatggtgacccagatggcgatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgccgccatgggcgcggtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggccgacctggagaacccccacctcccggagaagaagatcacgcagtggctggagaccaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctcaaggagaccgcctgcctgggcaaggcctacgcccagatgtggagcctgatgtacttccaccgccgggacctccgcctggcgtccaacgccatctgcagcgccgtccccgtgcactgggtgccgacctcccggacgacctggagcatccacgcccaccaccagtggatgaccaccgaggacatgctgacggtctggaaccgcgtgtggatcgaggacaacccctggatggaggacaagacccccgtgaccacctgggagaacgtcccctacctcgggaagcgggaggaccagtggtgcggcagcctgatcgggctgacgtcccgcgccacctgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10074 - RNA, 9873 nt, synthetic construct
  misc_feature 1..9873: note = derived and/or modified CDS sequence (opt1) from DENV-3__KF973485__SS-prME
  source 1..9873: mol_type = other RNA
accagcctctgcctcatgatgatcctgcccgcggccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaacaagaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcggctcgccacggccatcgccggcgcctgggagaacggggtctgcggcatccgcagcaccacccgcatggagaacctgctgtggaagcagatcgcgaacgagctcaactacatcctgtgggagaacaacatcaagctgaccgtggtggtcggggacatcatcggcgtgctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgtctcccgcgcctggaacgtgtgggaggtggaggactacgggttcggcgtcttcaccaccaacatctggctcaagctgcgggaggtgcacacccagctgtgcgaccaccgcctcatgagcgcggccgtgaaggacgagcgggccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgccggggtgttcttcaccttcgtcctgctcctgtccggccagatcacctggcgggacatggcgcacacgctgatcatgatcggcagcaacgcctccgaccgcatggggatgggcgtgacctacctcgccctgatcgccaccttcaagatccagcccttcctggccctcgggttcttcctgcggaagctgaccagccgcgagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcggaccgccaccctgatcctcgccggggtgagcctgctgccggtctgccagtccagctccatgcgcaagaccgactggctccccatggcggtggccgccatgggcgtgccgcccctcccgctgttcatcttcgggctcaaggacacgctgaagcggcgcagctggcccctgaacgagggcgtcatggccgtgggcctcgtgtccatcctggccagctccctgctccgcaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcggatcaaggacgacgagaccgagaacatcctcacggtcctgctgaagaccgccctcctgatcgtgagcggcatcttcccgtactccatccccgccaccctgctcgtgtggcacacctggcagaagcagacgcagcgcagcggggtcctgtgggacgtgcccagcccgcccgagacccagaaggccgagctggaggagggcgtgtaccggatcaagcagcaggggatcttcggcaagacccaggtcggggtgggcgtgcagaaggagggcgtcttccacaccatgtggcacgtgacgcgcggggcggtgctcacctacaacggcaagcggctggagcccaactgggccagcgtcaagaaggacctgatctcctacgggggcgggtggcgcctcagcgcccagtggaagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgggaggggaaggtggtgggcctgtacgggaacggcgtcgtgacgaagaacgggggctacgtgagcggcatcgcccagaccaacgccgagccggacgggcccacccccgagctggaggaggagatgttcaagaagcgcaacctcaccatcatggacctgcaccccggctccgggaagacgcggaagtacctgccggccatcgtccgcgaggcgatcaagcggcgcctccggaccctgatcctggcccccacccgcgtggtggccgccgagatggaggaggccctcaagggcctgcccatccggtaccagaccacggcgaccaagagcgagcacaccgggcgcgagatcgtcgacctgatgtgccacgccaccttcacgatgcggctcctgtcccccgtgcgcgtgccgaactacaacctgatcatcatggacgaggcccacttcaccgaccccgccagcatcgccgcgcggggctacatctccacccgcgtcggcatgggggaggccgccgccatcttcatgaccgcgacgccgcccggcaccgccgacgccttcccgcagagcaacgcccccatccaggacgaggagcgggacatccccgagcgctcctggaacagcgggaacgagtggatcaccgacttcgccggcaagaccgtgtggttcgtgccctccatcaaggcggggaacgacatcgccaactgcctccgcaagaacggcaagaaggtcatccagctgagccggaagacgttcgacaccgagtaccagaagaccaagctgaacgactgggacttcgtggtgaccacggacatctccgagatgggcgccaacttcaaggccgaccgcgtcatcgacccgcggcgctgcctcaagcccgtgatcctgaccgacgggcccgagcgggtgatcctggccggccccatgccggtcaccgtggcgagcgccgcccagcgccgggggcgcgtgggccggaacccccagaaggagaacgaccagtacatcttcaccgggcagcccctcaacaacgacgaggaccacgcccactggaccgaggccaagatgctgctggacaacatcaacacgcccgagggcatcatcccggccctcttcgagcccgagcgcgagaagtccgccgccatcgacggcgagtaccggctgaagggggagagccgcaagaccttcgtcgagctgatgcggcgcggcgacctccccgtgtggctggcccacaaggtcgcgtccgaggggatcaagtacaccgaccggaagtggtgcttcgacggccagcgcaacaaccagatcctggaggagaacatggacgtggagatctggaccaaggagggcgagaagaagaagctccggccccgctggctggacgcccggacgtacagcgacccgctggccctcaaggagttcaaggagttcgccgccgggcgcaagtccatcgcgctggacctggtgaccgagatcggccgcgtccccagccacctcgcccaccggacccgcaacgccctggacaacctggtgatgctccacacctccgagcacgggggccgggcctaccgccacgccgtggaggagctgcccgagacgatggagaccctgctcctgctggggctcatgatcctgctgaccggcggcgcgatgctgttcctgatcagcgggaagggcatcgggaagaccagcatcggcctgatctgcgtcatcgcctccagcgggatgctctggatggccgagatcccgctgcagtggatcgcctccgccatcgtgctggagttcttcatgatggtgctcctgatccccgagcccgagaagcagcggacgccccaggacaaccagctggcgtacgtcgtgatcggcatcctcaccctggccgccatcatcgccgccaacgagatgggcctgctcgagaccaccaagcgcgacctggggatgagcaaggagccgggcgtggtctcccccacgagctacctggacgtggacctccaccccgcgtccgcctggaccctgtacgccgtggccaccaccgtcatcacgcccatgctgcggcacaccatcgagaacagcaccgcgaacgtgtccctcgccgccatcgccaaccaggccgtggtcctgatggggctggacaagggctggccgatcagcaagatggacctcggggtgcccctgctggcgctcggctgctactcccaggtgaaccccctgaccctgacggccgccgtcctcctgctgatcacccactacgccatcatcggccccgggctccaggccaaggcgacccgcgaggcccagaagcggaccgccgccggcatcatgaagaacccgacggtggacgggatcatgaccatcgacctggaccccgtgatctacgacagcaagttcgagaagcagctgggccaggtcatgctcctggtgctgtgcgtggtccagctcctgctgatgcgcacctcctgggccctctgcgaggcgctgaccctggccacgggccccatcaccaccctctgggaggggagccccggcaagttctggaacaccacgatcgccgtgtccatggccaacatcttccgggggagctacctggcgggcgccgggctggccttctccatcatgaagtccgtgggcaccggcaagcgcgggaccggctcccagggggagaccctcggcgagaagtggaagaagaagctgaaccagctgagccggaaggacttcgacctctacaagaagtccgggatcaccgaggtcgaccgcacggaggccaaggagggcctgaagcggggcgagatcacccaccacgccgtgtcccgcgggagcgcgaagctgcagtggttcgtggagcggaacatggtcatcccggagggccgcgtgatcgacctcgggtgcggccgcgggggctggtcctactactgcgccggcctgaagaaggtgaccgaggtccgcgggtacaccaagggcgggcccggccacgaggagcccgtgcccatgagcacgtacgggtggaacatcgtgaagctgatgtccggcaaggacgtcttctacctcccgcccgagaagtgcgacaccctgctgtgcgacatcggcgagagctcccccagccccaccgtggaggagtcccggaccatccgcgtgctgaagatggtcgagccgtggctcaagaacaaccagttctgcatcaaggtgctgaacccctacatgcccacggtgatcgagcacctggagcgcctccagcggaagcacgggggcatgctggtccgcaaccccctgagccggaactccacccacgagatgtactggatcagcaacgggaccggcaacatcgtggcctccgtgaacatggtcagccgcctcctgctgaaccggttcaccatgacgcaccgccggccgaccatcgagaaggacgtggacctcggcgccgggacccgccacgtgaacgccgagcccgagacccccaacatggaggtcatcggcgagcggatcaagcgcatcaaggaggagcacaactccacgtggcactacgacgacgagaacccgtacaagacctgggcgtaccacgggagctacgaggtgaaggccaccggctccgccagctccatgatcaacggggtcgtgaagctgctgaccaagccctgggacatggtgcccatggtcacgcagatggccatgaccgacaccacccccttcggccagcagcgggtgttcaaggagaaggtggacacgcgcaccccgcggagcatgcccggcacccgccgggtcatggggatcaccgccgagtggctctggcgcacgctgggccggaacaagaagccccgcctgtgcacccgggaggagttcaccaagaaggtgcgcaccaacgcggccatgggggccgtgttcacggaggagaaccagtgggacagcgccaaggcggccgtcgaggacgaggacttctggaagctcgtggaccgcgagcgggagctgcacaagctgggcaagtgcgggtcctgcgtgtacaacatgatgggcaagcgcgagaagaagctcggcgagttcgggaaggccaagggcagccgggccatctggtacatgtggctgggggcccgctacctggagttcgaggcgctcggcttcctgaacgaggaccactggttctcccgggagaacagctactccggggtcgagggcgagggcctgcacaagctcgggtacatcctgcgcgacatcagcaagatccccggcggggccatgtacgccgacgacaccgccggctgggacacccggatcaccgaggacgacctgcacaacgaggagaagatcacgcagcagatggacccggagcaccgccagctcgccgacgcgatcttcaagctgacctaccagaacaaggtggtgaaggtccagcggcccacccccaccggcaccgtgatggacatcatctcccgcaaggaccagcgggggagcggccaggtggggacgtacggcctgaacaccttcaccaacatggaggcccagctcatccgccagatggagggggagggcgtcctgtccaaggccgacctggagaacccccacctcccggagaagaagatcacccagtggctggagacgaagggcgtggagcggctgaagcgcatggccatcagcggggacgactgcgtggtcaagcccatcgacgaccggttcgccaacgcgctcctggccctgaacgacatgggcaaggtgcgcaaggacatcccccagtggcagccctccaaggggtggcacgactggcagcaggtcccgttctgcagccaccacttccacgagctcatcatgaaggacggccggaagctggtcgtgccctgccgcccccaggacgagctgatcgggcgggcccgcatctcccagggcgccggctggagcctcaaggagaccgcctgcctggggaaggcgtacgcccagatgtggtccctgatgtacttccaccggcgcgacctccgcctggccagcaacgccatctgctccgcggtgcccgtccactgggtgccgaccagccggaccacgtggtccatccacgcccaccaccagtggatgaccaccgaggacatgctgaccgtgtggaaccgcgtctggatcgaggacaacccctggatggaggacaagacgcccgtgaccacctgggagaacgtgccctacctcggcaagcgggaggaccagtggtgcgggagcctgatcggcctgaccagccgcgccacgtgggcccagaacatcccgaccgccatccagcaggtccggtccctcatcgggaacgaggagttcctggactacatgcccagcatgaagcgcttccggaaggaggaggagtccgagggcgcgatctggtga

SEQ ID NO: 10075 - RNA, 9873 nt, synthetic construct
  misc_feature 1..9873: note = derived and/or modified CDS sequence (opt1) from DENV-3__KF973486__SS-prME
  source 1..9873: mol_type = other RNA
accagcctgtgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcgcacacgctgatcatgatcggcagcaacgcctccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcgggctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacatcacgtgggaggaggaggccgagcagaccggggtgtcccacaacctgatgatcaccgtggacgacgacggcaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggggtcctgtgggacgtgcccagcccgcccgagacccagaaggccgagctggaggagggcgtgtaccgcatcaagcagcaggggatcttcggcaagacccaggtcggggtgggcgtgcagaaggagggcgtcttccacaccatgtggcacgtgacgcgcggggccgtgctcacctacaacggcaagcggctggagcccaactgggccagcgtcaagaaggacctgatctcctacgggggcgggtggcggctcagcgcccagtggcagaagggcgaggaggtccaggtgatcgccgtcgagcccggcaagaaccccaagaacttccagaccatgcccgggaccttccagacgaccaccggcgagatcggggcgatcgccctggacttcaagcccggcacctccggcagccccatcatcaaccgcgaggggaaggtggtgggcctgtacgggaacggcgtcgtgacgaagaacgggggctacgtgagcggcatcgcccagaccaacgccgagccggacgggcccacccccgagctggaggaggagatgttcaagaagcggaacctcaccatcatggacctgcaccccggctccgggaagacgcgcaagtacctgccggccatcgtccgggaggcgatcaagcgccggctccgcaccctgatcctggcccccacccgggtggtggccgccgagatggaggaggccctcaagggcctgcccatccgctaccagaccacggcgaccaagagcgagcacaccgggcgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcggctacatctccacccgggtcggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtgccctccatcaaggcggggaacgacatcgccaactgcctccggaagaacggcaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacgggcccgagcgcgtgatcctggccggccccatgccggtcaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcgtggagctgatgcgccggggcgacctccccgtctggctggcgcacaaggtggcctccgaggggatcaagtacaccgaccgcaagtggtgcttcgacggccagcggaacaaccagatcctggaggagaacatggacgtcgagatctggaccaaggagggcgagaagaagaagctccgcccccggtggctggacgcccgcacgtacagcgacccgctggccctcaaggagttcaaggagttcgccgcggggcgcaagtccatcgccctggacctggtgaccgagatcggccgggtgcccagccacctcgcccaccgcacccggaacgccctggacaacctggtcatgctccacacctccgagcacgggggccgcgcctaccggcacgcggtggaggagctgcccgagacgatggagaccctgctcctgctggggctcatgatcctgctgaccggcggcgccatgctgttcctgatcagcgggaagggcatcgggaagaccagcatcggcctgatctgcgtgatcgcctccagcgggatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatgggcctgctcgagaccaccaagcgggacctggggatgagcaaggagccgggcgtggtgtcccccacgagctacctggacgtcgacctccaccccgcctccgcctggaccctgtacgccgtggcgaccaccgtgatcacgcccatgctgcgccacaccatcgagaacagcaccgccaacgtctccctcgccgccatcgccaaccaggcggtggtgctgatggggctggacaagggctggccgatcagcaagatggacctcggggcgcccctcctggccctcggctgctactcccaggtcaaccccctgaccctgacggccgccgtgctcctgctgatcacccactacgcgatcatcggccccgggctccaggccaaggccacccgggaggcccagaagcgcaccgccgcgggcatcatgaagaacccgacggtggacgggatcatgaccatcgacctggaccccgtcatctacgacagcaagttcgagaagcagctgggccaggtgatgctcctggtgctgtgcgccgtccagctcctgctgatgcggacctcctgggccctctgcgaggccctgaccctggcgacgggccccatcaccaccctctgggaggggagccccggcaagttctggaacaccacgatcgccgtgtccatggccaacatcttccgcgggagctacctggccggcgccgggctggcgttctccatcatgaagtccgtgggcaccggcaagcgggggaccggctcccagggggagaccctcggcgagaagtggaagaagaagctgaaccagctgagccgcaaggacttcgacctctacaagaagtccgggatcaccgaggtcgaccggacggaggccaaggagggcctgaagcgcggcgagatcacccaccacgccgtgtcccgggggagcgccaagctgcagtggttcgtggagcgcaacatggtcatcccggagggccgggtgatcgacctcgggtgcggccgcgggggctggtcctactactgcgccggcctgaagaaggtgaccgaggtccgggggtacaccaagggcgggcccggccacgaggagcccgtgcccatgagcacgtacgggtggaacatcgtgaagctgatgtccggcaaggacgtcttctacctcccgcccgagaagtgcgacaccctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccacggtgatcgagcacctggagcggctccagcgcaagcacgggggcatgctggtccggaaccccctgagccgcaactccacccacgagatgtactggatcagcaacgggaccggcaacatcgtggcgtccgtgaacatggtcagccggctcctgctgaaccgcttcaccatgacgcaccggcgcccgaccatcgagaaggacgtggacctcggcgccgggacccggcacgtgaacgccgagcccgagacccccaacatggacgtcatcggcgagcgcatcaagcggatcaaggaggagcacaactccacgtggcactacgacgacgagaacccgtacaagacctgggcctaccacgggagctacgaggtgaaggccaccggctccgcgagctccatgatcaacggggtggtcaagctgctgaccaagccctgggacgtggtccccatggtgacgcagatggccatgaccgacaccacccccttcggccagcagcgcgtgttcaaggagaaggtcgacacgcggaccccgcgcagcatgcccggcacccggcgcgtgatggggatcaccgccgagtggctctggcggacgctgggccgcaacaagaagccccggctgtgcacccgcgaggagttcaccaagaaggtgcgcaccaacgccgcgatgggggccgtcttcacggaggagaaccagtgggacagcgccaaggccgccgtggaggacgaggacttctggaagctcgtggaccgggagcgcgagctgcacaagctgggcaagtgcgggtcctgcgtctacaacatgatgggcaagcgggagaagaagctcggcgagttcgggaaggcgaagggcagccgcgccatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgcggacgacaccgccggctgggacacccgcatcaccgaggacgacctgcacaacgaggagaagatcacgcagcagatggacccggagcaccggcagctcgccaacgccatcttcaagctgacctaccagaacaaggtggtcaaggtgcagcgccccacccccaccggcaccgtgatggacatcatctcccggaaggaccagcgcgggagcggccaggtcgggacgtacggcctgaacaccttcaccaacatggaggcccagctcatccggcagatggagggggagggcgtgctgtccaaggcggacctggagaacccccacctcccggagaagaagatcacccagtggctggagacgaagggcgtggagcgcctgaagcggatggccatcagcggggacgactgcgtcgtgaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtggtgccctgccggccccaggacgagctgatcgggcgcgcgcggatctcccagggcgccggctggagcctcaaggagaccgcctgcctggggaaggcctacgcgcagatgtggtccctgatgtacttccaccgccgcgacctccggctggccagcaacgccatctgctccgccgtccccgtgcactgggtgccgaccagccgcaccacgtggtccatccacgcccaccaccagtggatgaccaccgaggacatgctgaccgtctggaaccgggtgtggatcgaggacaacccctggatggaggacaagacgcccgtgaccacctgggagaacgtcccctacctcggcaagcgcgaggaccagtggtgcgggagcctgatcggcctgaccagccgggcgacgtgggcccagaacatcccgaccgccatccagcaggtccgctccctcatcgggaacgaggagttcctggactacatgcccagcatgaagcggttccgcaaggaggaggagtccgagggcgccatctggtga

SEQ ID NO: 10076 - RNA, 9873 nt, synthetic construct
  misc_feature 1..9873: note = derived and/or modified CDS sequence (opt1) from DENV-3__FJ898458__SS-prME
  source 1..9873: mol_type = other RNA
accagcctctgcctcatgatgatcctgcccgccgccctggcgttccacctcaccagccgggacggggagccgcggatgatcgtggggaagaacgagcgggggaagaccctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggagcgtggccctcgcgccccacgtgggcatggggctggacacccgcacccagacctggatgtccgccgagggcgcctggcgccaggtggagaaggtggagacctgggccctgcgccacccggggttcaccatcctcgcgctgttcctggcccactacatcggcaccagcctcacgcagaaggtggtgatcttcatcctgctgatgctcgtcaccccctccatgaccatgcggtgcgtgggggtgggcaaccgcgacttcgtcgagggcctgagcggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggactcccgctgccccacccagggcgaggccgtgctgccggaggagcaggaccagaactacgtctgcaagcacacctacgtggaccgggggtggggcaacgggtgcggcctcttcgggaagggcagcctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggcctccaccaccgaggcgatcctgcccgagtacggcaccctggggctcgagtgcagcccgcgcacgggcctggacttcaacgagatgatcctgctcaccatgaagaacaaggcctggatggtgcaccggcagtggttcttcgacctgcccctgccctggacctccggcgccaccacggagacccccacctggaaccgcaaggagctcctggtgaccttcaagaacgcccacgccaagaagcaggaggtcgtggtgctggggagccaggagggcgcgatgcacacggccctcaccggggccaccgagatccagaactccggcgggaccagcatcttcgccggccacctgaagtgccggctgaagatggacaagctcgagctgaagggcatgtcctacgccatgtgcacgaacaccttcgtcctgaagaaggaggtgagcgagacccagcacgggaccatcctcatcaaggtggagtacaagggcgaggacgtcccgtgcaagatccccttctccacggaggacgggcacggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggcagctccatcgggaagatgttcgaggcgaccgcccggggcgcccgccggatggccatcctgggcgacacggcctgggacttcgggagcgtgggcggggtcctcaactccctgggcaagatggtgcaccagatcttcgggagcgcgtacaccgccctgttctccggcgtgagctgggtcatgaagatcggcatcggggtgctcctgacctggatcggcctgaactccaagaacaccagcatgtccttcagctgcatcgccatcgggatcatcacgctctacctgggcgccgtggtccaggccgacatggggtgcgtgatcaactggaagggcaaggagctgaagtgcggctccgggatcttcgtgaccaacgaggtccacacctggaccgagcagtacaagttccaggcggacagccccaagcgcctcgccacggccatcgccggcgcctgggagaacggggtgtgcggcatccgctccaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtacagctggaagacctgggggaaggccaagatcgtcaccgccgagacgcagaactccagcttcatcatcgacggccccaacacccccgagtgcccctccgccagccgggcgtggaacgtgtgggaggtggaggactacgggttcggcgtcttcaccaccaacatctggctcaagctgcgcgaggtgtacacccagctgtgcgaccaccggctcatgtccgccgccgtgaaggacgagcgcgccgtccacgccgacatgggctactggatcgagagccagaagaacgggagctggaagctggagaaggcgtccctgatcgaggtgaagacgtgcacctggcccaagtcccacaccctctggtccaacggcgtgctggagagcgacatgatcatccccaagtccctggccgggcccatcagccagcacaaccaccggccgggctaccacacccagacggccgggccctggcacctcggcaagctggagctggacttcaactactgcgagggcaccaccgtcgtgatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcagcgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgcgggggtgttcttcaccttcgtcctgctcctgagcggccagatcacctggcgcgacatggcccacacgctgatcatgatcggctccaacgccagcgaccggatggggatgggcgtgacctacctcgccctgatcgccaccttcaagatccagcccttcctggcgctcgggttcttcctgcgcaagctgacctcccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgcagcaacaccatcttcaccctgacggtcgcctggcgcaccgccaccctgatcctcgcgggggtgtccctgctgccggtctgccagagctccagcatgcggaagaccgactggctccccatgacggtggccgccatgggcgtgccgcccctcccgctgttcatcttctccctcaaggacaccctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggaccagcgccgacctgacggtcgagaaggccgcggacatcacctgggaggaggaggccgagcagaccggcgtgtcccacaacctgatgatcaccgtggacgacgacgggaccatgcgcatcaaggacgacgagacggagaacatcctcaccgtcctgctgaagaccgccctcctgatcgtgagcggcatcttcccgtactccatccccgccaccctgctcgtgtggcacacgtggcagaagcagacccagcggagcggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacacgatgtggcacgtgacccggggcgcggtgctcacctacaacgggaagcgcctggagcccaactgggccagcgtcaagaaggacctgatctcctacggcgggggctggcggctcagcgcccagtggaagaagggggaggaggtccaggtgatcgccgtcgagcccggcaagaaccccaagaacttccagaccatgcccggcacgttccagaccaccaccggggagatcggcgcgatcgccctggacttcaagcccgggacgtccggcagccccatcatcaaccgcgagggcaaggtggtggggctgtacggcaacggggtcgtgaccaagaacggcgggtacgtgagcggcatcgcccagaccaacgccgagccggacggccccacccccgagctggaggaggagatgttcaagaagcggaacctcacgatcatggacctgcaccccgggtccggcaagacccgcaagtacctgccggccatcgtccgggaggcgatcaagcgccggctccgcaccctgatcctggcccccacccgggtggtggccgccgagatggaggaggccctcaaggggctgcccatccgctaccagacgaccgcgaccaagagcgagcacaccggccgggagatcgtcgacctgatgtgccacgccacgttcaccatgcgcctcctgtcccccgtgcgggtgccgaactacaacctgatcatcatggacgaggcccacttcaccgaccccgccagcatcgccgcgcgcgggtacatctccacccgggtcggcatgggcgaggccgccgccatcttcatgacggcgacgccgcccgggaccgccgacgccttcccgcagagcaacgcccccatccaggacgaggagcgcgacatccccgagcgctcctggaacagcggcaacgagtggatcaccgacttcgccgggaagacggtgtggttcgtgccctccatcaaggcgggcaacgacatcgccaactgcctccggaagaacgggaagaaggtcatccagctgagccgcaagaccttcgacaccgagtaccagaagaccaagctgaacgactgggacttcgtggtgacgaccgacatctccgagatgggcgccaacttcaaggccgaccgggtcatcgacccgcgccggtgcctcaagcccgtgatcctgaccgacggccccgagcgcgtgatcctggccgggcccatgccggtcaccgcggccagcgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagagccggaagaccttcgtggagctgatgcgccgcggggacctccccgtctggctggcgcacaaggtggcctccgagggcatcaagtacaccgaccgcaagtggtgcttcgacgggcagcggaacaaccagatcctggaggagaacatggacgtcgagatctggacgaaggagggcgagaagaagaagctccgcccccggtggctggacgcccgcacctacagcgacccgctggccctcaaggagttcaaggacttcgccgcgggccgcaagtccatcgccctggacctggtgaccgagatcgggcgggtgcccagccacctcgcccaccgcacccggaacgccctggacaacctggtcatgctccacacgtccgagcacggcgggcgcgcctaccggcacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccacgaagcgggacctgggcatgagcaaggagccgggggtggtgtcccccaccagctacctggacgtcgacctccaccccgcctccgcctggaccctgtacgccgtggcgaccacggtgatcacccccatgctgcgccacaccatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgacgctgaccgccgccgtgctcctgctgatcacccactacgccatcatcggccccggcctccaggcgaaggccacccgggaggcccagaagcgcacggccgccgggatcatgaagaacccgaccgtcgacggcatcatgaccatcgacctggaccccgtgatctacgacagcaagttcgagaagcagctgggccaggtgatgctcctggtcctgtgcgcggtgcagctcctgctgatgcggacctcctgggccctctgcgaggccctgacgctggccaccggccccatcaccaccctctgggagggcagccccgggaagttctggaacacgaccatcgcggtgtccatggccaacatcttccgcggcagctacctggccggggccggcctggccttctccatcatgaagtccgtcgggaccggcaagcggggcaccgggtcccagggcgagaccctcggggagaagtggaagaagaagctgaaccagctgagccgcaaggagttcgacctctacaagaagtccggcatcacggaggtggaccggaccgaggcgaaggaggggctgaagcgcggcgagatcacccaccacgccgtgtcccggggcagcgccaagctgcagtggttcgtcgagcgcaacatggtgatcccggaggggcgggtgatcgacctcggctgcgggcgcggcgggtggtcctactactgcgccggcctgaagaaggtcaccgaggtgcggggctacacgaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccgcacgatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacccacgagatgtactggatcagcaacggcaccgggaacatcgtggcctccgtcaacatggtgagccggctcctgctgaaccgcttcacgatgacccaccggcgcccgaccatcgagaaggacgtggacctcggcgcgggcacccggcacgtcaacgccgagcccgagacgcccaacatggacgtgatcggggagcgcatcaagcggatcaaggaggagcacaactccacctggcactacgacgacgagaacccgtacaagacctgggcctaccacggcagctacgaggtgaaggccaccgggtccgccagctccatgatcaacggcgtcgtgaagctgctgacgaagccctgggacgtcgtgcccatggtgacccagatggcgatgaccgacaccacgcccttcgggcagcagcgcgtcttcaaggagaaggtggacacccggaccccgcgcagcatgcccggcacccggcgcgtgatgggcatcacggccgagtggctctggcggaccctggggcgcaacaagaagccccggctgtgcacccgcgaggagttcaccaagaaggtccgcacgaacgccgccatgggcgcggtgttcaccgaggagaaccagtgggacagcgccaaggccgccgtggaggacgaggacttctggaagctcgtcgaccgggagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtcgtgaaggtgcagcgccccacccccaccggcacggtcatggacatcatctcccggaaggaccagcgcggcagcggccaggtgggcacctacgggctgaacaccttcaccaacatggaggcccagctcatccggcagatggagggcgagggggtgctgtccaaggccgacctggagaacccccacctcccggagaagaagatcacgcagtggctggagaccaagggcgtcgagcgcctgaagcggatggcgatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcccggatctcccagggggcgggctggagcctccgcgagaccgcctgcctgggcaaggcctacgcccagatgtggtccctgatgtacttccaccgccgggacctccgcctggcgagcaacgccatctgctccgccgtgcccgtgcactgggtcccgaccagccggacgacctggtccatccacgcccaccaccagtggatgaccaccgaggacatgctgacggtgtggaaccgcgtgtggatcgaggacaacccctggatggaggacaagacccccgtcaccacctgggagaacgtgccctacctcgggaagcgggaggaccagtggtgcggcagcctgatcgggctgacgagccgcgccacctgggcgcagaacatcccgaccgccatccagcaggtccggtccctcatcggcaacgaggagttcctggactacatgcccagcatgaagcgcttccggaaggaggaggagtccgagggggccatctggtga

SEQ ID NO: 10077 - RNA, 9873 nt, synthetic construct
  misc_feature 1..9873: note = derived and/or modified CDS sequence (opt1) from DENV-3__KJ189256__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcacggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagaccacgaccggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtccgggaggccatcaagcgccggctccgcacgctgatcctggcccccacccgggtggtggccgccgagatggaggaggcgctcaaggggctgcccatccgctaccagaccaccgccacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgcggcccgcgggtacatcagcacccgggtcggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgcggccggccgcaagagcatcgccctggacctggtgacggagatcgggcgggtgccctcccacctcgcccaccgcacccggaacgccctggacaacctggtcatgctccacaccagcgagcacggcgggcgcgcgtaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgtccaaggagccgggggtggtgagccccacctcctacctggacgtcgacctccaccccgccagcgcctggacgctgtacgcggtggccaccaccgtgatcacccccatgctgcgccacacgatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggcgagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgcagcatgcccggcacccggcgcgtgatgggcatcaccgccgagtggctctggcggaccctggggcgcaacaagaagccccggctgtgcacgcgcgaggagttcaccaagaaggtccgcaccaacgccgcgatgggcgccgtgttcaccgaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggcggacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcgcggatcagccagggggccggctggtccctccgcgagacggcctgcctgggcaaggcctacgcgcagatgtggagcctgatgtacttccaccgccgggacctccgcctggcctccaacgccatctgcagcgccgtgcccgtgcactgggtcccgacctcccggaccacctggagcatccacgcccaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggcagcctgatcgggctgacctcccgcgcgacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 10078 - RNA, 9873 nt, synthetic construct
  misc_feature 1..9873: note = derived and/or modified CDS sequence (opt1) from DENV-3__KJ189257__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcacggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacacgtccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgttcctcctgatcacccactacgccatcatcggccccggcctgcaggcgaaggccacccgggaggcccagaagcgcaccgccgccgggatcatgaagaacccgacggtcgacggcatcatgaccatcgacctcgaccccgtgatctacgactccaagttcgagaagcagctgggccaggtgatgctgctcgtcctgtgcgcggtgcagctgctcctgatgcggaccagctgggccctgtgcgaggccctcaccctggccacgggccccatcaccaccctgtgggagggctcccccgggaagttctggaacaccacgatcgcggtgagcatggccaacatcttccgcggctcctacctcgccggggccggcctggccttcagcatcatgaagtccgtcgggaccggcaagcggggcaccgggagccagggcgagaccctgggggagaagtggaagaagaagctcaaccagctgagccgcaaggagttcgacctgtacaagaagtccggcatcaccgaggtggaccggacggaggcgaaggaggggctcaagcgcggcgagatcacccaccacgccgtgagccggggctccgccaagctgcagtggttcgtcgagcgcaacatggtgatcccggaggggcgggtgatcgacctgggctgcgggcgcggcgggtggagctactactgcgccggcctcaagaaggtcaccgaggtgcggggctacaccaagggcgggcccgggcacgaggagcccgtgcccatgtccacgtacggctggaacatcgtcaagctgatgagcgggaaggacgtgttctacctgccgcccgagaagtgcgacaccctcctgtgcgacatcggcgagtccagcccctcccccaccgtggaggagagccgcaccatccgcgtcctgaagatggtggagccgtggctgaagaacaaccagttctgcatcaaggtgctcaacccctacatgcccacggtcatcgagcacctggagcggctgcagcgcaagcacggcgggatgctcgtgcggaaccccctgtcccgcaacagcacccacgagatgtactggatctccaacggcaccgggaacatcgtggccagcgtcaacatggtgtcccggctgctcctgaaccgcttcaccatgacgcaccggcgcccgaccatcgagaaggacgtggacctgggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctcctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctgtggcggacgctcgggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctggtcgaccgggagcgcgagctccacaagctggggaagtgcggcagctgcgtgtacaacatgatggggaagcgggagaagaagctgggcgagttcggcaaggccaaggggtcccgcgcgatctggtacatgtggctcggcgcccggtacctggagttcgaggccctggggttcctcaacgaggaccactggttcagccgcgagaactcctacagcggcgtggagggggagggcctgcacaagctgggctacatcctccgggacatctccaagatccccgggggcgccatgtacgccgacgacaccgcggggtgggacacccgcatcaccgaggacgacctgcacaacgaggagaagatcacgcagcagatggacccggagcaccggcagctggccaacgccatcttcaagctcacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctgatccggcagatggagggcgagggggtgctcagcaaggccgacctggagaacccccacctccccgagaagaagatcacccagtggctcgagacgaagggcgtcgagcgcctgaagcggatggcgatctccggcgacgactgcgtggtgaagcccatcgacgaccgcttcgccaacgccctgctcgccctgaacgacatggggaaggtccggaaggacatcccccagtggcagcccagcaagggctggcacgactggcagcaggtcccgttctgctcccaccacttccacgagctgatcatgaaggacgggcgcaagctcgtggtcccctgccggccccaggacgagctgatcggccgcgcccggatcagccagggggcgggctggtccctgcgcgagaccgcctgcctcggcaaggcctacgcccagatgtggagcctgatgtacttccaccgccgggacctgcgcctcgcgtccaacgccatctgcagcgccgtgcccgtgcactgggtcccgacctcccggaccacgtggagcatccacgcccaccaccagtggatgaccaccgaggacatgctgaccgtgtggaaccgcgtgtggatcgaggacaacccctggatggaggacaagacgcccgtcaccacctgggagaacgtgccctacctggggaagcgggaggaccagtggtgcggcagcctcatcgggctgacctcccgcgccacgtgggcgcagaacatcccgaccgccatccagcaggtccggagcctgatcggcaacgaggagttcctcgactacatgccctccatgaagcgcttccggaaggaggaggagagcgagggggccatctggtga

SEQ ID NO: 10079 - RNA, 9873 nt, synthetic construct
  misc_feature 1..9873: note = derived and/or modified CDS sequence (opt1) from DENV-3__KJ189262__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcacggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcgatcgagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtgcgggaggccatcaagcgccggctccgcacgctgatcctggcccccacccgggtcgtggccgccgagatggaggaggcgctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgcggcccgcgggtacatcagcacccgggtgggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtctggttcgtgcccagcatcaaggccggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgcggccggccgcaagagcatcgccctggacctggtcacggagatcgggcgggtgccctcccacctcgcccaccgcacccggaacgccctggacaacctggtgatgctccacaccagcgagcacggcgggcgcgcgtaccggcacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcacgctggccgccatcatcgcggccaacgagatgggcctgctcgagaccaccaagcgggacctgggcatgtccaaggagccgggggtcgtgagccccacctcctacctggacgtggacctccaccccgccagcgcctggacgctgtacgcggtcgccaccaccgtgatcacccccatgctgcgccacacgatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgcgatcatcggccccggcctccaggccaaggccacccgggaggcccagaagcgcaccgccgcggggatcatgaagaacccgaccgtggacggcatcatgacgatcgacctggaccccgtcatctacgactccaagttcgagaagcagctgggccaggtgatgctcctggtgctgtgcgccgtccagctcctgctgatgcggaccagctgggccctctgcgaggccctgaccctggcgaccggccccatcacgaccctctgggagggctcccccgggaagttctggaacaccaccatcgccgtgagcatggccaacatcttccgcggctcctacctggccggggccggcctggcgttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagatcacgcaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccggggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggcgagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggccaccgggagcgcgtccagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgccgagtggctctggcggaccctggggcgcaacaagaagccccggctgtgcacgcgcgaggagttcaccaagaaggtgcgcaccaacgccgcgatgggcgccgtcttcaccgaggagaaccagtgggactccgccaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcccagctcatccggcagatggagggcgagggggtgctgagcaaggcggacctggagaacccccacctcccggagaagaagatcacccagtggctggagaccaagggcgtggagcgcctgaagcggatggccatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcgcggatcagccagggggccggctggtccctccgcgagacggcctgcctgggcaaggcctacgcgcagatgtggagcctgatgtacttccaccgccgggacctccgcctggcctccaacgccatctgcagcgccgtccccgtgcactgggtgccgacctcccggaccacctggagcatccacgcccaccaccagtggatgacgaccgaggacatgctgaccgtctggaaccgcgtgtggatcgaggacaacccctggatggaggacaagacccccgtgacgacctgggagaacgtcccctacctcgggaagcgggaggaccagtggtgcggcagcctgatcgggctgacctcccgcgcgacctgggcccagaacatcccgacggccatccagcaggtccggagcctcatcggcaacgaggagttcctggactacatgccctccatgaagcgcttccggaaggaggaggagagcgagggggccatctggtga

SEQ ID NO: 10080 - RNA, 9873 nt, synthetic construct
  misc_feature 1..9873: note = derived and/or modified CDS sequence (opt1) from DENV-3__KJ189263__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccgtgctcatcaaggtcgagtacaagggcgaggacgtgccgtgcaagatccccttcagcacggaggacgggcacggcaaggcgcacaacggccgcctgatcaccgccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtcggcggggtgctcaacagcctgggcaagatggtgcaccagatcttcgggtccgcgtacaccgccctgttcagcggcgtctcctgggtgatgaagatcggcatcggggtgctcctgacctggatcggcctgaacagcaagaacacctccatgagcttctcctgcatcgccatcgggatcatcacgctctacctgggcgccgtcgtgcaggccgacatggggtgcgtgatcaactggaagggcaaggagctgaagtgcggcagcgggatcttcgtcaccaacgaggtgcacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtcgtggtgggggacatcatcggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtgtgggaggtcgaggactacgggttcggcgtgttcaccaccaacatctggctccgcctgcgggaggtgtacacccagctgtgcgaccaccgcctcatgagcgccgccgtcaaggacgagcgggccgtgcacgccgacatgggctactggatcgagagccagaagaacgggtcctggaagctggagaaggcgagcctgatcgaggtgaagacgtgcacctggccgaagtcccacaccctctggagcaacggcgtcctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtgatcaccgagaactgcgggacgcggggccccagcctccgcaccaccaccgtctccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtcgacaacttcaccatgggcgtgctgtgcctcgccatcctgttcgaggaggtgatgcgcgggaagttcggcaagaagcacatgatcgcgggggtcttcttcaccttcgtgctgctcctgtccggccagatcacctggcgggacatggcccacacgctgatcatgatcggcagcaacgcctccgaccgcatggggatgggcgtgacctacctcgccctgatcgccaccttcaagatccagcccttcctggcgctcgggttcttcctgcggaagctgaccagccgcgagaacctcctgctgggcgtcggcctcgccatggccacgaccctgcagctgcccgaggacatcgagcagatggccaacgggatcgcgctcggcctgatggccctgaagctcatcacccagttcgagatctaccagctgtggaccgccctgatcagcctcacgtgctccaacaccatcttcaccctgaccgtggcctggcggacggccaccctgatcctcgcgggggtcagcctgctgccggtgtgccagtccagctccatgcgcaagaccgactggctccccatggccgtggccgccatgggcgtgccgcccctcccgctgttcatcttcagcctcaaggacaccctgaagcgccggtcctggcccctgaacgagggggtgatggccgtgggcctcgtcagcatcctggcgtccagcctgctccgcaacgacgtgcccatggccggccccctggtggccgggggcctgctcatcgcctgctacgtcatcacggggacctccgccgacctgaccgtggagaaggcggccgacatcacctgggaggaggaggccgagcagacgggcgtgagccacaacctgatgatcaccgtcgacgacgacgggaccatgcggatcaaggacgacgagaccgagaacatcctcaccgtgctgctgaagacggccctcctgatcgtgtccggcatcttcccgtacagcatccccgccaccctgctcgtctggcacacctggcagaagcagacccagcgctccggcgtgctgtgggacgtgcccagcccgcccgagacgcagaaggcggagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcctccgtgaagaaggacctgatcagctacggcgggggctggcgcctctccacccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgggagggcaaggtggtcgggctgtacggcaacggggtggtgacgaagaacggcgggtacgtctccggcatcgcccagaccaacgccgagccggacggccccacccccgagctggaggaggagatgttcaagaagcgcaacctcaccatcatggacctgcaccccgggagcggcaagacgcggaagtacctgccggccatcgtgcgcgaggcgatcaagcggcgcctccggaccctgatcctggcccccacccgcgtggtcgccgccgagatggaggaggccctcaaggggctgcccatccggtaccagaccacggcgaccaagtccgagcacaccggccgcgagatcgtggacctgatgtgccacgccaccttcacgatgcggctcctgagccccgtgcgcgtcccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtgtggttcgtccccagcatcaaggcgggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggacttcgccgcgggccgcaagagcatcgccctggacctggtgaccgagatcgggcgcgtcccctcccacctcgcccaccggacccgcaacgccctggacaacctggtgatgctccacaccagcgagcacggcgggcgggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgggtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgcgaggagttcaccaagaaggtgcggaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgcgagaccgcctgcctgggcaaggcctacgcccagatgtggagcctgatgtacttccaccggcgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10081 - RNA, 9873 nt, synthetic construct
  misc_feature 1..9873: note = derived and/or modified CDS sequence (opt1) from DENV-3__KJ189265__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcacggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcacggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacacgtccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatggcggtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcgaacatcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgccctcccacctcgcccaccgcacccggaacgccctggacaacctggtcatgctccacaccagcgagcacggcgggcgcgcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagaccaccaagcgggacctgggcatgtccaaggagccgggggtggtgagccccacgtcctacctggacgtcgacctccaccccgccagcgcctggaccctgtacgccgtggcgaccaccgtgatcacgcccatgctgcgccacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgggaggcccagaagcgcaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcggaccagctgggccctctgcgaggccctgaccctggccacgggccccatcaccaccctctgggagggctcccccgggaagttctggaacaccacgatcgcggtgagcatggccaacatcttccgcggctcctacctggccggggccggcctggccttcagcatcatgaagtccgtcgggaccggcaagcggggcaccgggagccagggcgagaccctcggggagaagtggaagaagaagctgaaccagctgagccgcaaggagttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcaccatgacgcaccggcgcccgaccatcgagaaggacgtggacctcggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctctggcggacgctggggcgcaacaagaagccccggctgtgcacccgcgaggagttcaccaagaaggtccgcaccaacgccgccatgggcgcggtgttcacggaggagaaccagtgggactccgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtgcactgggtcccgacctcccggaccacgtggagcatccacgcccaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10082 - RNA, 9873 nt, synthetic construct
  misc_feature 1..9873: note = derived and/or modified CDS sequence (opt1) from DENV-3__KJ189266__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcacggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggcggagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcctccgtcaagaaggacctgatcagctacggcgggggctggcggctctccgcccagtggcagaagggggaggaggtccaggtgatcgcgatcgagcccggcaagaaccccaagaacttccaggccatgcccggcaccttccagaccaccacgggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagaccaacgcggagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtcgtggccgcggagatggaggaggccctcaaggggctgcccatccgctaccagaccaccgccaccaagtccgagcacacgggccgggagatcgtggacctgatgtgccacgccaccttcaccatgcgcctcctgagccccgtccgggtgccgaactacaacctgatcatcatggacgaggcccacttcaccgaccccgcgtccatcgccgcccgcgggtacatcagcacgcgggtgggcatgggcgaggccgcggccatcttcatgaccgccacgccgcccgggaccgccgacgccttcccgcagtccaacgcgcccatccaggacgaggagcgcgacatccccgagcgcagctggaactccggcaacgagtggatcacggacttcgccgggaagaccgtctggttcgtgcccagcatcaaggccggcaacgacatcgccaactgcctccggaagaacgggaagaaggtgatccagctgtcccgcaagaccttcgacaccgagtaccagaagacgaagctgaacgactgggacttcgtcgtgaccaccgacatcagcgagatgggcgccaacttcaaggcggaccgggtgatcgacccgcgccggtgcctcaagcccgtcatcctgaccgacggccccgagcgcgtgatcctggccgggcccatgccggtgacggccgcctccgccgcgcagcggcgcggccgggtcgggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagaccttcgtggagctgatgcgccgcggggacctccccgtgtggctggcccacaaggtcgccagcgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtcaccgagatcgggcgggtgccctcccacctcgcccaccgcacgcggaacgcgctggacaacctggtgatgctccacaccagcgagcacggcgggcgcgcctaccggcacgccgtcgaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcgcacgccccaggacaaccagctggcctacgtggtgatcgggatcctcaccctggccgcgatcatcgccgccaacgagatgggcctgctcgagacgaccaagcgggacctgggcatgtccaaggagccgggggtcgtgagccccacctcctacctggacgtggacctccaccccgccagcgcgtggaccctgtacgccgtcgccacgaccgtgatcacccccatgctgcgccacaccatcgagaactccacggccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacccactacgccatcatcggccccggcctccaggccaaggccacgcgggaggcccagaagcgcaccgcggccgggatcatgaagaacccgaccgtggacggcatcatgaccatcgacctggaccccgtcatctacgactccaagttcgagaagcagctgggccaggtgatgctcctggtgctgtgcgccgtccagctcctgctgatgcggacgagctgggccctctgcgaggcgctgaccctggccaccggccccatcaccacgctctgggagggctcccccgggaagttctggaacaccaccatcgccgtgagcatggccaacatcttccgcggctcctacctggccggggcgggcctggccttcagcatcatgaagtccgtggggaccggcaagcggggcacggggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgcgggcctgaagaaggtgacggaggtccggggctacaccaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccacggtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcacggggaacatcgtggccagcgtgaacatggtctcccggctcctgctgaaccgcttcaccatgacccaccggcgcccgaccatcgagaaggacgtggacctcggcgccggcacgcggcacgtgaacgccgagcccgagacccccaacatggacgtcatcggggagcgcatcaagcggatcaaggaggagcacaacagcacctggcactacgacgacgagaacccgtacaagacctgggcctaccacggctcctacgaggtgaaggcgacggggagcgcctccagcatgatcaacggcgtggtcaagctgctgaccaagccctgggacgtggtccccatggtgacccagatggccatgaccgacacgacccccttcgggcagcagcgcgtgttcaaggagaaggtcgacacccggaccccgcgcagcatgcccggcacgcggcgcgtgatgggcatcaccgccgagtggctctggcggaccctggggcgcaacaagaagccccggctgtgcacccgcgaggagttcacgaagaaggtgcgcaccaacgcggccatgggcgccgtcttcaccgaggagaaccagtgggactccgccaaggccgcggtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacaccgccgggtgggacacgcgcatcaccgaggacgacctgcacaacgaggagaagatcacccagcagatggacccggagcaccggcagctcgccaacgccatcttcaagctgacctaccagaacaaggtggtcaaggtgcagcgccccacgcccaccggcaccgtgatggacatcatcagccggaaggaccagcgcggctccgggcaggtcggcacctacgggctgaacaccttcacgaacatggaggcgcagctcatccggcagatggagggcgagggggtgctgagcaaggccgacctggagaacccccacctcccggagaagaagatcacccagtggctggagaccaagggcgtggagcgcctgaagcggatggccatctccggcgacgactgcgtcgtgaagcccatcgacgaccgcttcgccaacgccctcctggcgctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagaccgcctgcctgggcaaggcgtacgcccagatgtggagcctgatgtacttccaccgccgggacctccgcctggcctccaacgccatctgcagcgccgtccccgtgcactgggtgccgacgtcccggaccacctggagcatccacgcgcaccaccagtggatgaccacggaggacatgctgaccgtctggaaccgcgtgtggatcgaggacaacccctggatggaggacaagacccccgtgaccacgtgggagaacgtcccctacctcgggaagcgggaggaccagtggtgcggcagcctgatcgggctgacctcccgcgccacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10083 - RNA, 9873 nt, synthetic construct
  misc_feature 1..9873: note = derived and/or modified CDS sequence (opt1) from DENV-3__KJ189268__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggaccaagaacgccctggacaacctggtgatgctccacacgagcgagcacggcgggcgcgcgtaccggcacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccctggccgccaccatcgcggccaacgagatgggcctgctcgagacgaccaagcgggacctgggcatgtccaaggagccgggggtcgtgagccccacctcctacctggacgtggacctccaccccgccagcgcctggaccctgtacgcggtcgccacgaccgtgatcacccccatgctgcgccacaccatcgagaactccacggccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgaccgccgccgtgctcctgctgatcacccactacgcgatcatcggccccggcctccaggccaaggccacgcgggaggcccagaagcgcaccgccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcggacgagctgggccctctgcgaggccctgaccctggcgaccggccccatcaccacgctctgggagggctcccccgggaagttctggaacaccaccatcgccgtgagcatggccaacatcttccgcggctcctacctggccggggccggcctggcgttcagcatcatgaagtccgtggggaccggcaagcggggcaccgggagccagggcgagacgctcggggagaagtggaagaagaagctgaaccagctgagccgcaaggagttcgacctctacaagaagtccggcatcaccgaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgacggaggtccggggctacaccaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccacggtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcacggggaacatcgtggcgagcgtgaacatggtctcccggctcctgctgaaccgcttcaccatgacccaccggcgcccgaccatcgagaaggacgtggacctcggcgccggcacgcggcacgtgaacgccgagcccgagacccccaacatggacgtcatcggggagcgcatcaagcggatcaaggaggagcacaacagcacctggcactacgacgacgagaacccgtacaagacctgggcctaccacggctcctacgaggtgaaggccacggggagcgcgtccagcatgatcaacggcgtggtcaagctgctgaccaagccctgggacgtggtccccatggtgacccagatggccatgaccgacacgacccccttcgggcagcagcgcgtgttcaaggagaaggtcgacacccggaccccgcgcagcatgcccggcacgcggcgcgtgatgggcatcaccgccgagtggctctggcggaccctggggcgcaacaagaagccccggctgtgcacccgcgaggagttcacgaagaaggtgcgcaccaacgccgcgatgggcgccgtcttcaccgaggagaaccagtgggactccgccaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacgcgcatcaccgaggacgacctgcacaacgaggagaagatcacccagcagatggacccggagcaccggcagctcgccaacgccatcttcaagctgacctaccagaacaaggtggtcaaggtgcagcgccccacccccacgggcaccgtgatggacatcatcagccggaaggaccagcgcggctccgggcaggtcggcacctacgggctgaacaccttcacgaacatggaggcccagctcatccggcagatggagggcgagggggtgctgagcaaggcggacctggagaacccccacctcccggagaagaagatcacccagtggctggagaccaagggcgtggagcgcctgaagcggatggccatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcgcggatcagccagggggccggctggtccctccgcgagaccgcctgcctgggcaaggcctacgcgcagatgtggagcctgatgtacttccaccgccgggacctccgcctggcctccaacgccatctgcagcgccgtccccgtgcactgggtgccgacgtcccggaccacctggagcatccacgcccaccaccagtggatgaccacggaggacatgctgaccgtctggaaccgcgtgtggatcgaggacaacccctggatggaggacaagacccccgtgaccacgtgggaggacgtcccctacctcgggaagcgggaggaccagtggtgcggcagcctgatcgggctgacctcccgcgcgacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10084 - RNA, 9873 nt, synthetic construct
  misc_feature 1..9873: note = derived and/or modified CDS sequence (opt1) from DENV-3__KJ189271__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagctgggcaagaagcacatgatcgccggggtgttcttcaccttcgtgctcctgctgtccggccagatcacctggcgggacatggcccacacgctcatcatgatcggcagcaacgcctccgaccgcatggggatgggcgtcacctacctggccctgatcgcgaccttcaagatccagcccttcctcgccctggggttcttcctgcggaagctcaccagccgcgagaacctgctgctcggcgtgggcctggccatggccacgaccctgcagctccccgaggacatcgagcagatggcgaacgggatcgccctgggcctgatggccctcaagctgatcacccagttcgagacctaccagctgtggacggccctcatcagcctgacctgctccaacaccatcttcaccctgacggtggcctggcggaccgcgaccctcatcctggccggggtcagcctgctcccggtgtgccagtccagctccatgcgcaagaccgactggctgcccatggccgtcgccgccatgggcgtgccgcccctgcccctgttcatcttcagcctgaaggacacgctgaagcgccggtcctggcccctcaacgagggggtgatggcggtcggcctggtgagcatcctggcctccagcctcctgcgcaacgacgtgcccatggccggccccctggtcgccgggggcctcctgatcgcctgctacgtgatcaccgggacctccgcggacctgaccgtggagaaggccgccgacatcacgtgggaggaggaggccgagcagaccggcgtcagccacaacctcatgatcaccgtggacgacgacgggaccatgcggatcaaggacgacgagaccgagaacatcctgacggtgctgctcaagaccgccctgctgatcgtctccggcatcttcccgtacagcatccccgcgaccctcctggtgtggcacacctggcagaagcagacgcagcgctccggcgtgctgtgggacgtccccagcccgcccgagacccagaaggccgagctcgaggagggggtgtaccggatcaagcagcagggcatcttcgggaagacccaggtgggcgtcggggtgcagaaggagggcgtgttccacaccatgtggcacgtcacgcgcggcgccgtgctgacctacaacgggaagcggctggagcccaactgggcctccgtgaagaaggacctcatcagctacggcgggggctggcgcctgtccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctcgaggaggagatgttcaagaagcgcaacctgacgatcatggacctgcaccccgggagcggcaagacccggaagtacctcccggcgatcgtgcgcgaggccatcaagcggcgcctgcggaccctgatcctcgcccccacccgcgtcgtggccgccgagatggaggaggcgctgaaggggctgcccatccggtaccagacgaccgccaccaagtccgagcacaccggccgcgagatcgtggacctcatgtgccacgccacgttcaccatgcggctgctgagccccgtccgcgtgccgaactacaacctcatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctgcgcaagaacgggaagaaggtgatccagctgtcccggaagaccttcgacaccgagtaccagaagaccaagctcaacgactgggacttcgtcgtgacgaccgacatcagcgagatgggcgccaacttcaaggccgaccgcgtgatcgacccgcggcgctgcctgaagcccgtcatcctgaccgacggccccgagcgggtgatcctcgcggggcccatgccggtgaccgccgcctccgccgcccagcgccggggccgcgtcgggcggaacccccagaaggagaacgaccagtacatcttcaccggccagcccctgaacaacgacgaggaccacgcgcactggacggaggccaagatgctgctcgacaacatcaacacccccgaggggatcatcccggccctgttcgagcccgagcgcgagaagtccgccgcgatcgacggcgagtaccggctgaagggcgagtcccgcaagaccttcgtggagctcatgcggcgcggggacctgcccgtgtggctggcccacaaggtcgccagcgagggcatcaagtacaccgaccggaagtggtgcttcgacgggcagcgcaacaaccagatcctcgaggagaacatggacgtggagatctggacgaaggagggcgagaagaagaagctgcggccccgctggctggacgcccgcacctactccgacccgctcgccctgaaggagttcaaggacttcgcggccggccgcaagagcatcgccctggacctcgtcaccgagatcgggcgcgtgccctcccacctggcccaccggacccgcaacgccctggacaacctcgtgatgctgcacacgagcgagcacggcgggcgggcgtaccgccacgccgtcgaggagctgcccgagaccatggagaccctcctgctgctcggcctgatgatcctgctcaccgggggcgccatgctgttcctgatcagcggcaaggggatcggcaagacgtccatcgggctcatctgcgtgatcgccagctccggcatgctgtggatggccgagatcccgctgcagtggatcgcgagcgccatcgtgctcgagttcttcatgatggtcctgctgatccccgagcccgagaagcagcggacgccccaggacaaccagctcgcctacgtggtgatcgggatcctgaccctggccgccatcatcgcggccaacgagatgggcctcctggagaccacgaagcgcgacctgggcatgtccaaggagccgggggtcgtgagccccacctcctacctcgacgtggacctgcaccccgccagcgcctggaccctgtacgcggtcgccaccacggtgatcacccccatgctccggcacaccatcgagaactccaccgccaacgtgagcctggccgccatcgcgaaccaggccgtcgtgctgatgggcctcgacaaggggtggccgatctccaagatggacctgggcgtgcccctgctcgccctggggtgctacagccaggtcaaccccctgacgctcaccgccgccgtgctgctgctcatcacccactacgcgatcatcggccccggcctgcaggccaaggccacccgcgaggcccagaagcggacggccgcggggatcatgaagaacccgaccgtggacggcatcatgaccatcgacctggaccccgtcatctacgactccaagttcgagaagcagctcggccaggtgatgctgctggtgctctgcgccgtccagctgctgctcatgcgcaccagctgggccctgtgcgaggccctgacgctcgcgaccggccccatcaccaccctgtgggagggctcccccgggaagttctggaacacgaccatcgccgtgagcatggccaacatcttccggggctcctacctggccggggccggcctcgcgttcagcatcatgaagtccgtggggaccggcaagcgcggcaccgggagccagggcgagaccctgggggagaagtggaagaagaagctgaaccagctcagccggaaggagttcgacctgtacaagaagtccggcatcacggaggtcgaccgcaccgaggccaaggaggggctgaagcggggcgagatcacccaccacgccgtgagccgcggctccgccaagctccagtggttcgtggagcggaacatggtcatcccggaggggcgcgtgatcgacctgggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctcatgagcgggaaggacgtcttctacctgccgcccgagaagtgcgacaccctgctgtgcgacatcggcgagtccagcccctcccccaccgtggaggagagccgcacgatccgggtgctcaagatggtcgagccgtggctgaagaacaaccagttctgcatcaaggtgctgaacccctacatgcccaccgtgatcgagcacctcgagcgcctgcagcggaagcacggcgggatgctggtccgcaaccccctctcccggaacagcacccacgagatgtactggatctccaacggcaccgggaacatcgtggcgagcgtgaacatggtctcccgcctgctgctcaaccggttcacgatgacccaccgccggccgaccatcgagaaggacgtggacctgggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtggtcaagctgctcacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctgtggcgcaccctggggcggaacaagaagccccgcctctgcacccgcgaggagttcaccaagaaggtgcggacgaacgccgcgatgggcgccgtcttcaccgaggagaaccagtgggactccgccaaggccgccgtggaggacgaggacttctggaagctggtggaccgcgagcgggagctgcacaagctcgggaagtgcggcagctgcgtctacaacatgatggggaagcgcgagaagaagctgggcgagttcggcaaggcgaaggggtcccgggccatctggtacatgtggctgggcgcccgctacctcgagttcgaggccctggggttcctgaacgaggaccactggttcagccgggagaactcctacagcggcgtggagggggagggcctccacaagctgggctacatcctgcgcgacatctccaagatccccgggggcgccatgtacgcggacgacaccgccgggtgggacacccggatcacggaggacgacctccacaacgaggagaagatcacccagcagatggacccggagcaccgccagctggccaacgccatcttcaagctgacctaccagaacaaggtggtcaaggtgcagcggcccacccccaccggcacggtgatggacatcatcagccgcaaggaccagcggggctccgggcaggtcggcacctacgggctcaacaccttcaccaacatggaggcccagctgatccgccagatggagggcgagggggtgctgagcaaggcggacctcgagaacccccacctcccggagaagaagatcacgcagtggctggagaccaagggcgtggagcggctcaagcgcatggccatctccggcgacgactgcgtcgtgaagcccatcgacgaccggttcgccaacgccctgctggccctcaacgacatggggaaggtgcgcaaggacatcccccagtggcagcccagcaagggctggcacgactggcagcaggtcccgttctgctcccaccacttccacgagctgatcatgaaggacgggcggaagctggtggtgccctgccgcccccaggacgagctcatcggccgggcgcgcatcagccagggggccggctggtccctgcgcgagaccgcctgcctgggcaaggcctacgcgcagatgtggagcctcatgtacttccaccggcgcgacctgcggctggcctccaacgccatctgcagcgccgtccccgtgcactgggtgccgacctcccgcacgacctggagcatccacgcccaccaccagtggatgaccaccgaggacatgctcacggtctggaaccgggtgtggatcgaggacaacccctggatggaggacaagacccccgtgaccacctgggaggacgtcccctacctggggaagcgcgaggaccagtggtgcggcagcctgatcgggctcacgtcccgggcgacctgggcccagaacatcccgaccgccatccagcaggtccgcagcctgatcggcaacgaggagttcctggactacatgccctccatgaagcggttccgcaaggaggaggagagcgagggggccatctggtga

SEQ ID NO: 10085 - RNA, 9873 nt, synthetic construct
  misc_feature 1..9873: note = derived and/or modified CDS sequence (opt1) from DENV-3__KJ189272__SS-prME
  source 1..9873: mol_type = other RNA
accagcctctgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccctacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgagcatcgaggccgagccgcccttcggggagtccaacatcgtcatcggcatcggggacaacgcgctgaagatcaactggtacaagaagggcagctccatcgggaagatgttcgaggccaccgcccggggcgcccgccggatggccatcctgggcgacacggcgtgggacttcgggagcgtgggcggggtgctcaactccctgggcaagatggtccaccagatcttcgggagcgcctacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcggacatggggtgcgtcatcaactggaagggcaaggagctgaagtgcggctccgggatcttcgtgaccaacgaggtgcacacctggaccgagcagtacaagttccaggccgacagccccaagcgcctcgccacggccatcgccggcgcgtgggagaacggggtctgcggcatccgctccaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtacagctggaagacctgggggaaggccaagatcgtgaccgccgagacgcagaactccagcttcatcatcgacggccccaacacccccgagtgcccctccgcgagccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagtcccagaagaacgggagctggaagctggagaaggcctccctgatcgaggtcaagacgtgcacctggcccaagtcccacaccctctggtccaacggcgtgctggagagcgacatgatcatccccaagtccctggccgggcccatcagccagcacaaccaccgcccgggctaccacacccagacggccgggccctggcacctcggcaagctggagctggacttcaactactgcgagggcaccaccgtggtcatcaccgagaactgcgggacgcggggcccctccctccgcaccaccaccgtgagcgggaagctgatccacgagtggtgctgccggtcctgcacgctgcccccgctccgctacatgggcgaggacgggtgctggtacggcatggagatccggcccatcagcgagaaggaggagaacatggtgaagtccctggtcagcgccggctccgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgagcggccagatcacctggcgggacatggcccacacgctgatcatgatcggctccaacgccagcgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatctccctgacctgcagcaacaccatcttcaccctgacggtggcctggcggaccgcgaccctgatcctcgccggggtctccctgctgccggtgtgccagagctccagcatgcgcaagaccgactggctccccatggccgtcgccgccatgggcgtgccgcccctcccgctgttcatcttctccctcaaggacacgctgaagcgccggagctggcccctgaacgagggggtgatggcggtcggcctcgtgtccatcctggccagctccctgctccgcaacgacgtgcccatggccggccccctggtcgccgggggcctgctcatcgcctgctacgtgatcaccgggaccagcgcggacctgaccgtggagaaggccgccgacatcacgtgggaggaggaggccgagcagaccggcgtctcccacaacctgatgatcaccgtggacgacgacgggaccatgcggatcaaggacgacgagaccgagaacatcctcacggtgctgctgaagaccgccctcctgatcgtcagcggcatcttcccgtactccatccccgcgaccctgctcgtgtggcacacctggcagaagcagacgcagcgcagcggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggccagcgtgaagaaggacctgatctcctacggcgggggctggcgcctcagcacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggctcccccatcatcaaccgggagggcaaggtcgtggggctgtacggcaacggggtggtcaccaagaacggcgggtacgtgagcggcatcgcccagaccaacgccgagccggacggccccacccccgagctggaggaggagatgttcaagaagcgcaacctcacgatcatggacctgcaccccgggtccggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagagcgagcacaccggccgcgagatcgtggacctgatgtgccacgccacgttcaccatgcggctcctgtcccccgtccgcgtgccgaactacaacctgatcatcatggacgaggcccacttcaccgaccccgccagcatcgcggcccgggggtacatctccacccgcgtgggcatgggcgaggccgccgcgatcttcatgacggccacgccgcccgggaccgccgacgccttcccgcagagcaacgcccccatccaggacgaggagcgcgacatccccgagcggtcctggaacagcggcaacgagtggatcaccgacttcgcggggaagacggtctggttcgtgccctccatcaaggccggcaacgacatcgccaactgcctccgcaagaacgggaagaaggtgatccagctgagccggaagaccttcgacaccgagtaccagaagaccaagctgaacgactgggacttcgtcgtgacgaccgacatctccgagatgggcgccaacttcaaggccgaccgcgtgatcgacccgcggcgctgcctcaagcccgtcatcctgaccgacggccccgagcgggtgatcctggcggggcccatgccggtgaccgccgccagcgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagagccgcaagaccttcgtggagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctacagcgacccgctggccctcaaggagttcaaggacttcgcggccggccggaagtccatcgccctggacctggtcaccgagatcgggcgcgtgcccagccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatctccggcaaggggatcggcaagacgagcatcgggctgatctgcgtgatcgcctccagcggcatgctctggatggccgagatcccgctgcagtggatcgcgtccgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgagcaaggagccgggggtcgtgtcccccaccagctacctggacgtggacctccaccccgcctccgcctggaccctgtacgcggtcgccaccacggtgatcacccccatgctgcggcacaccatcgagaacagcaccgccaacgtgtccctcgccgccatcgcgaaccaggccgtcgtgctgatgggcctggacaaggggtggccgatcagcaagatggacctcggcgtgcccctgctggccctcgggtgctactcccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgacagcaagttcgagaagcagctgggccaggtgatgctcctggtgctgtgcgccgtccagctcctgctgatgcgcacctcctgggccctctgcgaggccctgacgctggcgaccggccccatcaccaccctctgggagggcagccccgggaagttctggaacacgaccatcgccgtgtccatggccaacatcttccggggcagctacctggccggggccggcctggcgttctccatcatgaagtccgtggggaccggcaagcgcggcaccgggagccagggcgagaccctcggggagaagtggaagaagaagctgaaccagctgtcccggaaggagttcgacctctacaagaagtccggcatcacggaggtcgaccgcaccgaggccaaggaggggctgaagcggggcgagatcacccaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcaccgggaacatcgtggcgtccgtgaacatggtcagccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaactccacctggcactacgacgacgagaacccgtacaagacctgggcctaccacggcagctacgaggtgaaggccaccgggtccgcgagcagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggtccatgcccggcacccgccgggtgatgggcatcacggccgagtggctctggcgcaccctggggcggaacaagaagccccgcctgtgcacccgcgaggagttcaccaagaaggtgcggacgaacgccgcgatgggcgccgtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatctcccgcaaggaccagcggggcagcgggcaggtcggcacctacgggctgaacaccttcaccaacatggaggcccagctcatccgccagatggagggcgagggggtgctgtccaaggcggacctggagaacccccacctcccggagaagaagatcacgcagtggctggagaccaagggcgtggagcggctgaagcgcatggccatcagcggcgacgactgcgtcgtgaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcgcgcatctcccagggggccggctggagcctccgcgagaccgcctgcctgggcaaggcctacgcgcagatgtggtccctgatgtacttccaccggcgcgacctccggctggccagcaacgccatctgctccgccgtccccgtgcactgggtgccgaccagccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggctccctgatcgggctgacgagccgggcgacctgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 10086 - RNA, 9873 nt, synthetic construct
  misc_feature 1..9873: note = derived and/or modified CDS sequence (opt1) from DENV-3__KJ189273__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggtgaccctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtcaccttcaagaacgcccacgccaagaagcaggaggtggtggtcctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtgtccgagacccagcacgggaccatcctcatcaaggtcgagtacaagggcgaggacgccccgtgcaagatccccttcagcacggaggacgggcacggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctccgcctgcgggaggtgtacacccagctgtgcgaccaccgcctcatgagcgccgccgtgaaggacgagcgggccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgttcttcaccttcgtcctgctcctgtccggccagatcacctggcgggacatggcccacacgctgatcatgatcggcagcaacgcctccgaccgcatggggatgggcgtgacctacctcgccctgatcgccaccttcaagatccagcccttcctggcgctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcatcacccagttcgagatctaccagctgtggaccgccctgatcagcctcacgtgctccaacaccatcttcaccctgaccgtcgcctggcggacggccaccctgatcctcgcgggggtgagcctgctgccggtctgccagtccagctccatgcgcaagaccgactggctccccatggccgtggccgccatgggcgtgccgcccctcccgctgttcatcttcagcctcaaggacaccctgaagcgccggtcctggcccctgaacgagggggtcatggccgtgggcctcgtgagcatcctggcgtccagcctgctccgcaacgacgtccccatggccggccccctggtggccgggggcctgctcatcgcctgctacgtgatcacggggacctccgccgacctgaccgtcgagaaggcggccgacatcacctgggaggaggaggccgagcagacgggcgtgagccacaacctgatgatcaccgtggacgacgacgggaccatgcggatcaaggacgacgagaccgagaacatcctcaccgtcctgctgaagacggccctcctgatcgtgtccggcatcttcccgtacagcatccccgccaccctgctcgtgtggcacacctggcagaagcagacccagcgctccggcgtcctgtgggacgtgcccagcccgcccgagacgcagaaggcggagctggaggagggggtgtaccggatcaagcagcagggcatcttcgggaagacccaggtcggcgtgggggtgcagaaggagggcgtcttccacaccatgtggcacgtgacccgcggcgccgtgctcacgtacaacgggaagcggctggagcccaactgggcctccgtcaagaaggacctgatcagctacggcgggggctggcgcctctccacccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgggagggcaaggtggtggggctgtacggcaacggggtcgtgacgaagaacggcgggtacgtgtccggcatcgcccagaccaacgccgagccggacggccccacccccgagctggaggaggagatgttcaagaagcgcaacctcaccatcatggacctgcaccccgggagcggcaagacgcggaagtacctgccggccatcgtccgcgaggcgatcaagcggcgcctccggaccctgatcctggcccccacccgcgtggtggccgccgagatggaggaggccctcaaggggctgcccatccggtaccagaccacggcgaccaagtccgagcacaccggccgcgagatcgtcgacctgatgtgccacgccaccttcacgatgcggctcctgagccccgtgcgcgtgccgaactacaacctgatcatcatggacgaggcccacttcaccgaccccgcctccatcgccgcgcgggggtacatcagcacccgcgtcggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtgtggttcgtgcccagcatcaaggcgggcaacgacatcgccaactgcctccgcaagaacgggaagaaggtcatccagctgtcccggaagacgttcgacaccgagtaccagaagaccaagctgaacgactgggacttcgtggtgaccacggacatcagcgagatgggcgccaacttcaaggccgaccgcgtcatcgacccgcggcgctgcctcaagcccgtgatcctgaccgacggccccgagcgggtgatcctggccgggcccatgccggtcaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtactccgacccgctggccctcaaggagttcaaggacttcgccgcgggccgcaagagcatcgccctggacctggtgaccgagatcgggcgcgtgccctcccacctcgcccaccggacccgcaacgccctggacaacctggtcatgctccacaccagcgagcacggcgggcgggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccaccaagcgcgacctgggcatgtccaaggagccgggggtggtgagccccacgtcctacctggacgtcgacctccaccccgccagcgcctggaccctgtacgccgtggcgaccaccgtgatcacgcccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgcgaggcccagaagcggaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgggtcctgaagatggtggagccgtggctcaagaacaaccagttctgcatcaaggtgctgaacccctacatgcccacggtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcaccatgacgcaccgccggccgaccatcgagaaggacgtggacctcggcgcgggcacccgccacgtcaacgccgagcccgagacccccaacatggacgtgatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtcgtgcccatggtgacgcagatggcgatgaccgacaccacccccttcgggcagcagcgggtcttcaaggagaaggtggacacgcgcaccccgcggagcatgcccggcacccgccgggtgatgggcatcaccgccgagtggctctggcgcacgctggggcggaacaagaagccccgcctgtgcacccgcgaggagttcaccaagaaggtccggaccaacgccgccatgggcgcggtgttcacggaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccctccgcgagaccgcctgcctgggcaaggcctacgcccagatgtggagcctgatgtacttccaccggcgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggaggacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10087 - RNA, 9873 nt, synthetic construct
  misc_feature 1..9873: note = derived and/or modified CDS sequence (opt1) from DENV-3__KJ189274__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggccgccggacgctgacgccccagccgatggagctgaagtactcctggaagacctgggggaaggccaagatcgtgaccgccgagacgcagaacagctccttcatcatcgacggccccaacacccccgagtgccccagcgcgtcccgcgcctggaacgtctgggaggtggaggactacgggttcggcgtgttcaccaccaacatctggctccggctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacacgctgatcatgatcggcagcaacgcctccgaccggatggggatgggcgtcacctacctcgccctgatcgcgaccttcaagatccagcccttcctggccctcgggttcttcctgcgcaagctgaccagccgggagaacctcctgctgggcgtgggcctcgccatggccacgaccctgcagctgcccgaggacatcgagcagatggcgaacgggatcgccctcggcctgatggccctgaagctcatcacccagttcgagatctaccagctgtggaccgccctgatcagcctcacgtgctccaacaccatcttcaccctgaccgtggcctggcgcacggcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacaccctgaagcggcgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgcgaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgccgtgctcacgtacaacgggaagcgcctggagcccaactgggcctccgtgaagaaggacctgatcagctacggcgggggctggcggctctccacccagtggcagaagggggaggaggtccaggtgatcgcggtggagcccggcaagaaccccaagaacttccagaccatgcccggcaccttccagacgaccaccggggagatcggcgccatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtgcgggaggccatcaagcgccggctccgcaccctgatcctggcccccacccgggtcgtggccgccgagatggaggaggcgctcaaggggctgcccatccgctaccagaccacggccaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgaccgccacgccgcccgggaccgccgacgccttcccgcagtccaacgcccccatccaggacgaggagcgggacatccccgagcgcagctggaactccggcaacgagtggatcaccgacttcgcggggaagaccgtctggttcgtgcccagcatcaaggccggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccgctggctggacgcccggacgtactccgacccgctggccctcaaggagttcaaggacttcgcggccggccgcaagagcatcgccctggacctggtcaccgagatcgggcgggtgccctcccacctcgcccaccgcacccggaacgccctggacaacctggtgatgctccacaccagcgagcacggcgggcgcgcgtaccggcacgccgtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccctggccgccatcatcgcggccaacgagatgggcctgctcgagaccaccaagcgggacctgggcatgtccaaggagccgggggtcgtgagccccacgtcctacctggacgtggacctccaccccgccagcgcctggaccctgtacgcggtcgccaccaccgtgatcacgcccatgctgcgccacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgacggccgccgtgctcctgctgatcacccactacgcgatcatcggccccggcctccaggccaaggccacccgggaggcccagaagcgcaccgccgcggggatcatgaagaacccgacggtggacggcatcatgaccatcgacctggaccccgtcatctacgactccaagttcgagaagcagctgggccaggtgatgctcctggtgctgtgcgccgtccagctcctgctgatgcggaccagctgggccctctgcgaggccctgaccctggcgacgggccccatcaccaccctctgggagggctcccccgggaagttctggaacaccacgatcgccgtgagcatggccaacatcttccgcggctcctacctggccggggccggcctggcgttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtcgaccggacggaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcaccatgacgcaccggcgcccgaccatcgagaaggacgtggacctcggcgccggcacccggcacgtgaacgccgagcccgagacccccaacatggacgtcatcggggagcgcatcaagcggatccgcgaggagcacaacagcacgtggcactacgacgacgagaacccgtacaagacctgggcctaccacggctcctacgaggtgaaggccaccgggagcgcgtccagcatgatcaacggcgtggtcaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcgcaacaagaagccccggctgtgcacccgcgaggagttcaccaagaaggtgcggaccaacgccgcgatgggcgccgtcttcacggaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggcggacctggagaacccccacctcccggagaagaagatcacccagtggctggagacgaagggcgtggagcggctgaagcgcatggccatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgcgcgcggatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggaggacgtcccctacctcgggaagcgcgaggaccagtggtgcggcagcctgatcgggctgacctcccgggcgacgtgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10088 - RNA, 9873 nt, synthetic construct
  misc_feature 1..9873: note = derived and/or modified CDS sequence (opt1) from DENV-3__KJ189275__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggccgccggacgctgacgccccagccgatggagctgaagtactcctggaagacctgggggaaggccaagatcgtgaccgccgagacgcagaacagctccttcatcatcgacggccccaacacccccgagtgccccagcgcgtcccgcgcctggaacgtctgggaggtggaggactacgggttcggcgtgttcaccaccaacatctggctccggctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacacgctgatcatgatcggcagcaacgcctccgaccggatggggatgggcgtcacctacctcgccctgatcgcgaccttcaagatccagcccttcctggccctcgggttcttcctgcgcaagctgaccagccgggagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcgcaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcggcgctcctggcccctgaacgagggggtgatggcggtcggcctcgtgagcatcctggcctccagcctgctccggaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgcgaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcctccgtgaagaaggacctgatcagctacggcgggggctggcggctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgcgagggcaaggtcgtggggctgtacggcaacggggtggtcaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtgcgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgcggcccgcgggtacatcagcacccgcgtgggcatgggcgaggccgccgcgatcttcatgacggccacgccgcccgggaccgccgacgccttcccgcagtccaacgcccccatccaggacgaggagcgggacatccccgagcgcagctggaactccggcaacgagtggatcaccgacttcgcggggaagacggtctggttcgtgcccagcatcaaggccggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccgctggctggacgcccggacctactccgacccgctggccctcaaggagttcaaggacttcgcggccggccgcaagagcatcgccctggacctggtcaccgagatcgggcgggtgccctcccacctcgcccaccgcacccggaacgccctggacaacctggtgatgctccacacgagcgagcacggcgggcgcgcgtaccggcacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcgcacgccccaggacaaccagctggcctacgtggtgatcgggatcctcaccctggccgccatcatcgcggccaacgagatgggcctgctcgagaccacgaagcgggacctgggcatgtccaaggagccgggggtcgtgagccccacctcctacctggacgtggacctccaccccgccagcgcctggaccctgtacgcggtcgccaccacggtgatcacccccatgctgcgccacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgggaggcccagaagcgcacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcggaccagctgggccctctgcgaggccctgacgctggcgaccggccccatcaccaccctctgggagggctcccccgggaagttctggaacacgaccatcgccgtgagcatggccaacatcttccgcggctcctacctggccggggccggcctggcgttcagcatcatgaagtccgtggggaccggcaagcggggcaccgggagccagggcgagaccctcggggagaagtggaagaagaagctgaaccagctgagccgcaaggagttcgacctctacaagaagtccggcatcacggaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcacgatgacccaccggcgcccgaccatcgagaaggacgtggacctcggcgccggcacccggcacgtgaacgccgagcccgagacgcccaacatggacgtcatcggggagcgcatcaagcggatccgcgaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcgcaacaagaagccccggctgtgcacccgcgaggagttcaccaagaaggtgcggacgaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggcggacctggagaacccccacctcccggagaagaagatcacgcagtggctggagaccaagggcgtggagcggctgaagcgcatggccatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgcgcgcggatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggcagcctgatcgggctgacgtcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10089 - RNA, 9873 nt, synthetic construct
  misc_feature 1..9873: note = derived and/or modified CDS sequence (opt1) from DENV-3__KJ189276__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagacggccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctccagtgctccccgcgcacgggcctggacttcaacgagatgatcctgctcaccatgaagaacaaggcctggatggtgcaccggcagtggttcttcgacctgcccctgccctggaccagcggcgccacctccgagacgcccacctggaaccgcaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgcgccgtgcaagatccccttcagcaccgaggacgggcacggcaaggcccacaacggccgcctgatcacggccaaccccgtcgtgaccaagaaggaggagcccgtgaacatcgaggccgagccgcccttcggggagtccaacatcgtcatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtgggcggggtgctcaactccctgggcaagatggtccaccagatcttcgggagcgcctacacggccctgttctccggcgtgagctgggtgatgaagatcggcatcggggtcctcctgacctggatcggcctgaactccaagaacaccagcatgtccttcagctgcatcgccatcgggatcatcaccctctacctgggcgccgtggtgcaggcggacatggggtgcgtcatcaactggaagggcaaggagctgaagtgcggctccgggatcttcgtgacgaacgaggtgcacacctggaccgagcagtacaagttccaggccgacagccccaagcgcctcgccaccgccatcgccggcgcgtgggagaacggggtctgcggcatccgctccacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtacagctggaagacctgggggaaggccaagatcgtgaccgccgagacccagaactccagcttcatcatcgacggccccaacacgcccgagtgcccctccgcgagccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagtcccagaagaacgggagctggaagctggagaaggcctccctgatcgaggtcaagacctgcacgtggcccaagtcccacaccctctggtccaacggcgtgctggagagcgacatgatcatccccaagtccctggccgggcccatcagccagcacaaccaccgcccgggctaccacacccagaccgccgggccctggcacctcggcaagctggagctggacttcaactactgcgagggcacgaccgtggtcatcaccgagaactgcgggacccggggcccctccctccgcacgaccaccgtgagcgggaagctgatccacgagtggtgctgccggtcctgcaccctgcccccgctccgctacatgggcgaggacgggtgctggtacggcatggagatccggcccatcagcgagaaggaggagaacatggtgaagtccctggtcagcgccggctccgggaaggtggacaacttcacgatgggcgtgctgtgcctcgcgatcctgttcgaggaggtcatgcgcgggaagttcggcaagaagcacatgatcgccggggtgttcttcaccttcgtgctgctcctgagcggccagatcacctggcgggacatggcccacaccctgatcatgatcggctccaacgccagcgaccgcatggggatgggcgtcacgtacctcgccctgatcgcgaccttcaagatccagcccttcctggccctcgggttcttcctgcggaagctgaccagccgcgagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatctccctcacgtgcagcaacaccatcttcaccctgaccgtggcctggcggacggcgaccctgatcctcgccggggtctccctgctgccggtgtgccagagctccagcatgcgcaagaccgactggctccccatggccgtcgccgccatgggcgtgccgcccctcccgctgttcatcttctccctcaaggacaccctgaagcgccggagctggcccctgaacgagggggtgatggcggtcggcctcgtgtccatcctggccagctccctgctccgcaacgacgtgcccatggccggccccctggtcgccgggggcctgctcatcgcctgctacgtgatcacggggaccagcgcggacctgaccgtggagaaggccgccgacatcacctgggaggaggaggccgagcagacgggcgtctcccacaacctgatgatcaccgtggacgacgacgggaccatgcggatcaaggacgacgagaccgagaacatcctcaccgtgctgctgaagacggccctcctgatcgtcagcggcatcttcccgtactccatccccgcgaccctgctcgtgtggcacacctggcagaagcagacccagcgcagcggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggccagcgtgaagaaggacctgatctcctacggcgggggctggcgcctcagcacccagtggcagaagggggaggaggtccaggtgatcgcggtggagcccggcaagaaccccaagaacttccagaccatgcccggcaccttccagacgaccaccggggagatcggcgccatcgccctggacttcaagcccgggaccagcggctcccccatcatcaaccgggagggcaaggtcgtggggctgtacggcaacggggtggtcacgaagaacggcgggtacgtgagcggcatcgcccagaccaacgccgagccggacggccccacccccgagctggaggaggagatgttcaagaagcgcaacctcaccatcatggacctgcaccccgggtccggcaagacgcggaagtacctgccggcgatcgtgcgcgaggccatcaagcggcgcctccggaccctgatcctggcccccacccgcgtcgtggccgccgagatggaggaggcgctcaaggggctgcccatccggtaccagaccacggccaccaagagcgagcacaccggccgcgagatcgtggacctgatgtgccacgccaccttcacgatgcggctcctgtcccccgtccgcgtgccgaactacaacctgatcatcatggacgaggcccacttcaccgaccccgccagcatcgcggcccgggggtacatctccacccgcgtgggcatgggcgaggccgccgcgatcttcatgaccgccacgccgcccgggaccgccgacgccttcccgcagagcaacgcccccatccaggacgaggagcgcgacatccccgagcggtcctggaacagcggcaacgagtggatcaccgacttcgcggggaagaccgtctggttcgtgccctccatcaaggccggcaacgacatcgccaactgcctccgcaagaacgggaagaaggtgatccagctgagccggaagacgttcgacaccgagtaccagaagaccaagctgaacgactgggacttcgtcgtgaccacggacatctccgagatgggcgccaacttcaaggccgaccgcgtgatcgacccgcggcgctgcctcaagcccgtcatcctgaccgacggccccgagcgggtgatcctggcggggcccatgccggtgaccgccgccagcgccgcccagcgccggggccgcgtcgggcggaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgcgagaagtccgccgcgatcgacggcgagtaccggctgaagggcgagagccgcaagaccttcgtggagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtacagcgacccgctggccctcaaggagttcaaggacttcgcggccggccggaagtccatcgccctggacctggtcaccgagatcgggcgcgtgcccagccacctcgcccaccggacccgcaacgccctggacaacctggtgatgctccacaccagcgagcacggcgggcgggcgtaccgccacgccgtcgaggagctgcccgagacgatggagaccctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcgtccgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccaccaagcgcgacctgggcatgagcaaggagccgggggtcgtgtcccccacgagctacctggacgtggacctccaccccgcctccgcctggaccctgtacgcggtcgccaccaccgtgatcacgcccatgctgcggcacaccatcgagaacagcaccgccaacgtgtccctcgccgccatcgcgaaccaggccgtcgtgctgatgggcctggacaaggggtggccgatcagcaagatggacctcggcgtgcccctgctggccctcgggtgctactcccaggtcaaccccctgaccctgacggccgccgtgctcctgctgatcacccactacgcgatcatcggccccggcctccaggccaaggccacccgcgaggcccagaagcggaccgccgcggggatcatgaagaacccgacggtggacggcatcatgaccatcgacctggaccccgtcatctacgacagcaagttcgagaagcagctgggccaggtgatgctcctggtgctgtgcgccgtccagctcctgctgatgcgcacctcctgggccctctgcgaggccctgaccctggcgacgggccccatcaccaccctctgggagggcagccccgggaagttctggaacaccacgatcgccgtgtccatggccaacatcttccggggcagctacctggccggggccggcctggcgttctccatcatgaagtccgtggggaccggcaagcgcggcaccgggagccagggcgagaccctcggggagaagtggaagaagaagctgaaccagctgtcccggaaggagttcgacctctacaagaagtccggcatcaccgaggtcgaccgcacggaggccaaggaggggctgaagcggggcgagatcacccaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacaccaagggcgggcccgggcacgaggagcccgtgcccatgagcacgtacggctggaacatcgtgaagctgatgtccgggaaggacgtcttctacctcccgcccgagaagtgcgacaccctgctgtgcgacatcggcgagagctcccccagccccaccgtggaggagtcccgcaccatccgggtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgagccggaactccacccacgagatgtactggatcagcaacggcaccgggaacatcgtggcgtccgtgaacatggtcagccgcctcctgctgaaccggttcaccatgacgcaccgccggccgaccatcgagaaggacgtggacctcggcgccggcacccgccacgtgaacgccgagcccgagacccccaacatggacgtcatcggggagcggatcaagcgcatcaaggaggagcacaactccacgtggcactacgacgacgagaacccgtacaagacctgggcctaccacggcagctacgaggtgaaggccaccgggtccgcgagcagcatgatcaacggcgtggtcaagctgctgaccaagccctgggacgtggtccccatggtgacgcagatggccatgaccgacaccacccccttcgggcagcagcgggtgttcaaggagaaggtcgacacgcgcaccccgcggtccatgcccggcacccgccgggtgatgggcatcaccgccgagtggctctggcgcacgctggggcggaacaagaagccccgcctgtgcacccgcgaggagttcaccaagaaggtgcggaccaacgccgcgatgggcgccgtcttcacggaggagaaccagtggaacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacccggatcaccgaggacgacctgcacaacgaggagaagatcacgcagcagatggacccggagcaccgccggctcgccaacgccatcttcaagctgacctaccagaacaaggtggtcaaggtgcagcgccccacccccaccggcaccgtgatggacatcatctcccggaaggaccagcgcggcagcgggcaggtcggcacgtacgggctgaacaccttcaccaacatggaggcccagctcatccggcagatggagggcgagggggtgctgtccaaggcggacctggagaacccccacctcccggagaagaagatcacccagtggctggagacgaagggcgtggagcgcctgaagcggatggccatcagcggcgacgactgcgtcgtgaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtggtgccctgccggccccaggacgagctgatcggccgcgcgcgcatctcccagggggccggctggagcctccgggagaccgcctgcctgggcaaggcctacgcgcagatgtggtccctgatgtacttccaccgccgggacctccgcctggccagcaacgccatctgctccgccgtccccgtgcactgggtgccgaccagccggaccacgtggagcatccacgcccaccaccagtggatgaccaccgaggacatgctgaccgtctggaaccgcgtgtggatcgaggacaacccctggatggaggacaagacgcccgtgaccacctgggaggacgtcccctacctcgggaagcgggaggaccagtggtgcggctccctgatcgggctgaccagccgcgcgacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10090 - RNA, 9873 nt, synthetic construct
  misc_feature 1..9873: note = derived and/or modified CDS sequence (opt1) from DENV-3__KJ189277__SS-prME
  source 1..9873: mol_type = other RNA
accagcctgtgcctcatgatgatcctgcccgccgccctggcgttccacctcaccagccgcgacggggagccgcggatgatcgtggggaagaacgagcgcggcaagagcctgctgttcaagacggccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctccagtgctccccgcgcacgggcctggacttcaacgagatgatcctgctcaccatgaagaacaaggcctggatggtgcaccggcagtggttcttcgacctgcccctgccctggaccagcggcgccacctccgagacgcccacctggaaccgcaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgcgccgtgcaagatccccttcagcaccgaggacgggcacggcaaggcccacaacggccgcctgatcacggccaaccccgtcgtgaccaagaaggaggagcccgtgaacatcgaggccgagccgcccttcggggagtccaacatcgtcatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtgggcggggtgctcaactccctgggcaagatggtccaccagatcttcgggagcgcctacacggccctgttctccggcgtgagctgggtgatgaagatcggcatcggggtcctcctgacctggatcggcctgaactccaagaacaccagcatgtccttcagctgcatcgccatcgggatcatcaccctctacctgggcgccgtggtgcaggcggacatggggtgcgtcatcaactggaagggcaaggagctgaagtgcggctccgggatcttcgtgacgaacgaggtgcacacctggaccgagcagtacaagttccaggccgacagccccaagcgcctcgccaccgccatcgccggcgcgtgggagaacggggtctgcggcatccgctccacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtacagctggaagacctgggggaaggccaagatcgtgaccgccgagacccagaactccagcttcatcatcgacggccccaacacgcccgagtgcccctccgcgagccgggcctggaacgtctgggaggtggaggactacgggttcggcgtgttcaccaccaacatctggctccgcctgcgggaggcctacacccagctgtgcgaccaccgcctcatgagcgccgccgtcaaggacgagcgggcggtgcacgccgacatgggctactggatcgagtcccagaagaacgggagctggaagctggagaaggcctccctgatcgaggtgaagacctgcacgtggcccaagtcccacaccctctggtccaacggcgtcctggagagcgacatgatcatccccaagtccctggccgggcccatcagccagcacaaccaccgcccgggctaccacacccagaccgccgggccctggcacctcggcaagctggagctggacttcaactactgcgagggcacgaccgtggtgatcaccgagaactgcgggacccggggcccctccctccgcacgaccaccgtcagcgggaagctgatccacgagtggtgctgccggtcctgcaccctgcccccgctccgctacatgggcgaggacgggtgctggtacggcatggagatccggcccatcagcgagaaggaggagaacatggtgaagtccctggtgagcgcgggctccgggaaggtcgacaacttcacgatgggcgtgctgtgcctcgccatcctgttcgaggaggtgatgcgcgggaagttcggcaagaagcacatgatcgccggggtcttcttcaccttcgtgctgctcctgagcggccagatcacctggcgggacatggcccacaccctgatcatgatcggctccaacgccagcgaccgcatggggatgggcgtgacgtacctcgcgctgatcgccaccttcaagatccagcccttcctggccctcgggttcttcctgcggaagctgaccagccgcgagaacctcctgctgggcgtcggcctcgccatggcgaccacgctgcagctgcccgaggacatcgagcagatggccaacgggatcgccctcggcctgatggccctgaagctcatcacccagttcgagacctaccagctgtggaccgccctgatctccctcacgtgcagcaacaccatcttcaccctgaccgtggcgtggcggacggccaccctgatcctcgccggggtgtccctgctgccggtctgccagagctccagcatgcgcaagaccgactggctccccatggccgtggccgcgatgggcgtgccgcccctcccgctgttcatcttctccctcaaggacaccctgaagcgccggagctggcccctgaacgagggggtgatggccgtgggcctcgtctccatcctggccagctccctgctccgcaacgacgtgcccatggccggccccctggtggccgggggcctgctcatcgcgtgctacgtcatcacggggaccagcgccgacctgaccgtggagaaggccgccgacatcacctgggaggaggaggccgagcagacgggcgtgtcccacaacctgatgatcaccgtcgacgacgacgggaccatgcggatcaaggacgacgagaccgagaacatcctcaccgtgctgctgaagacggcgctcctgatcgtgagcggcatcttcccgtactccatccccgccaccctgctcgtctggcacacctggcagaagcagacccagcgcagcggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcgagcgtgaagaaggacctgatctcctacggcgggggctggcgcctcagcacccagtggcagaagggggaggaggtgcaggtcatcgccgtggagcccggcaagaaccccaagaacttccagaccatgcccggcaccttccagacgaccaccggggagatcggcgccatcgccctggacttcaagcccgggaccagcggctcccccatcatcaaccgggagggcaaggtggtcgggctgtacggcaacggggtggtgacgaagaacggcgggtacgtcagcggcatcgcccagaccaacgcggagccggacggccccacccccgagctggaggaggagatgttcaagaagcgcaacctcaccatcatggacctgcaccccgggtccggcaagacgcggaagtacctgccggccatcgtgcgcgaggccatcaagcggcgcctccggaccctgatcctggcccccacccgcgtggtcgccgcggagatggaggaggccctcaaggggctgcccatccggtaccagaccacggccaccaagagcgagcacaccggccgcgagatcgtggacctgatgtgccacgccaccttcacgatgcggctcctgtcccccgtgcgcgtcccgaactacaacctgatcatcatggacgaggcccacttcaccgaccccgcgagcatcgccgcccgggggtacatctccacccgcgtgggcatgggcgaggccgcggccatcttcatgaccgccacgccgcccgggaccgccgacgccttcccgcagagcaacgcgcccatccaggacgaggagcgcgacatccccgagcggtcctggaacagcggcaacgagtggatcaccgacttcgccgggaagaccgtgtggttcgtcccctccatcaaggccggcaacgacatcgccaactgcctccgcaagaacgggaagaaggtgatccagctgagccggaagacgttcgacaccgagtaccagaagaccaagctgaacgactgggacttcgtggtcaccacggacatctccgagatgggcgccaacttcaaggcggaccgcgtgatcgacccgcggcgctgcctcaagcccgtgatcctgaccgacggccccgagcgggtcatcctggccgggcccatgccggtgaccgccgccagcgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccggctgaagggcgagagccgcaagaccttcgtcgagctgatgcggcgcggggacctccccgtgtggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtacagcgacccgctggcgctcaaggagttcaaggacttcgccgccggccggaagtccatcgccctggacctggtgaccgagatcgggcgcgtccccagccacctcgcccaccggacccgcaacgcgctggacaacctggtgatgctccacaccagcgagcacggcgggcgggcctaccgccacgccgtggaggagctgcccgagacgatggagaccctgctcctgctgggcctcatgatcctgctgaccgggggcgccatgctgttcctgatctccggcaaggggatcggcaagaccagcatcgggctgatctgcgtcatcgcctccagcggcatgctctggatggcggagatcccgctgcagtggatcgcctccgccatcgtgctggagttcttcatgatggtgctcctgatccccgagcccgagaagcagcggacgccccaggacaaccagctggcctacgtcgtgatcgggatcctcaccctggccgcgatcatcgccgccaacgagatgggcctgctcgagaccaccaagcgcgacctgggcatgagcaaggagccgggggtggtctcccccacgagctacctggacgtggacctccaccccgcctccgcgtggaccctgtacgccgtggccaccaccgtcatcacgcccatgctgcggcacaccatcgagaacagcaccgccaacgtgtccctcgccgcgatcgccaaccaggccgtggtcctgatgggcctggacaaggggtggccgatcagcaagatggacctcggcgtgcccctgctggccctcgggtgctactcccaggtgaaccccctgaccctgacggccgcggtcctcctgctgatcacccactacgccatcatcggccccggcctccaggccaaggccacccgcgaggcccagaagcggaccgcggccgggatcatgaagaacccgacggtggacggcatcatgaccatcgacctggaccccgtgatctacgacagcaagttcgagaagcagctggggcaggtcatgctcctggtgctgtgcgccgtgcagctcctgctgatgcgcacctcctgggccctctgcgaggcgctgaccctggccacgggccccatcaccaccctctgggagggcagccccgggaagttctggaacaccacgatcgccgtctccatggccaacatcttccggggcagctacctggccggggcgggcctggccttctccatcatgaagtccgtggggaccggcaagcgcggcaccgggagccagggcgagaccctcggggagaagtggaagaagaagctgaaccagctgtcccggaaggagttcgacctctacaagaagtccggcatcaccgaggtggaccgcacggaggccaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgcgggcctgaagaaggtgaccgaggtgcgcggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccgcaccatccgggtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcaccatgacgcaccgccggccgaccatcgagaaggacgtcgacctcggcgccggcacccgccacgtgaacgccgagcccgagacccccaacatggacgtgatcggggagcggatcaagcgcatcaaggaggagcacaactccacgtggcactacgacgacgagaacccgtacaagacctgggcctaccacggcagctacgaggtcaaggcgaccgggtccgccagcagcatgatcaacggcgtggtgaagctgctgaccaagccctgggacgtcgtgcccatggtcacgcagatggccatgaccgacaccacccccttcgggcagcagcgggtgttcaaggagaaggtggacacgcgcaccccgcggtccatgcccggcacccgccgggtcatgggcatcaccgccgagtggctctggcgcacgctggggcggaacaagaagccccgcctgtgcacccgcgaggagttcaccaagaaggtgcggaccaacgcggccatgggcgccgtgttcacggaggagaaccagtggaacagcgccaaggccgcggtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgcgatgtacgccgacgacaccgccgggtgggacacccggatcaccgaggacgacctgcacaacgaggagaagatcacgcagcagatggacccggagcaccgccggctcgccaacgccatcttcaagctgacctaccagaacaaggtggtgaaggtccagcgccccacccccaccggcaccgtgatggacatcatctcccggaaggaccagcgcggcagcggccaggtgggcacgtacgggctgaacaccttcaccaacatggaggcgcagctcatccggcagatggagggcgagggggtcctgtccaaggccgacctggagaacccccacctcccggagaagaagatcacccagtggctggagacgaagggcgtggagcgcctgaagcggatggccatcagcggcgacgactgcgtggtcaagcccatcgacgaccgcttcgccaacgccctcctggcgctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccgcatctcccagggggccggctggagcctccgggagaccgcctgcctgggcaaggcgtacgcccagatgtggtccctgatgtacttccaccgccgggacctccgcctggccagcaacgccatctgctccgccgtgcccgtccactgggtgccgaccagccggaccacgtggagcatccacgcgcaccaccagtggatgaccaccgaggacatgctgaccgtgtggaaccgcgtctggatcgaggacaacccctggatggaggacaagacgcccgtgaccacctgggaggacgtgccctacctcgggaagcgggaggaccagtggtgcggctccctgatcgggctgaccagccgcgccacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10091 - RNA, 9873 nt, synthetic construct
  misc_feature 1..9873: note = derived and/or modified CDS sequence (opt1) from DENV-3__KJ189278__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggaccaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacgtggatgagcgccgagggcgcctggcgccaggtggagaaggtggagacctgggccctgcgccacccggggttcaccatcctcgcgctgttcctggcccactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgaccctgcccgagtacggcacgctggggctcgagtgctccccgcgcaccggcctggacttcaacgagatgatcctgctcaccatgaagaacaaggcctggatggtgcaccggcagtggttcttcgacctgcccctgccctggaccagcggcgccacgaccgagacccccacctggaaccgcaaggagctcctggtgacgttcaagaacgcccacgccaagaagcaggaggtcgtggtgctggggtcccaggagggcgcgatgcacaccgccctcaccggggccaccgagatccagaacagcggcgggacgtccatcttcgccggccacctgaagtgccggctgaagatggacaagctcgagctgaagggcatgagctacgccatgtgcaccaacaccttcgtcctgaagaaggaggtgtccgagacccagcacgggacgatcctcatcaaggtggagtacaagggcgaggacgcgccgtgcaagatccccttcagcaccgaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccacggcccggggcgcccgccggatggccatcctgggcgacaccgcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacctggacggagcagtacaagttccaggccgactcccccaagcgcctcgccaccgccatcgccggcgcgtgggagaacggggtctgcggcatccgcagcaccacccggatggagaacctgctgtggaagcagatcgccaacgagctcaactacatcctgtgggagaacaacgtgaagctgacggtggtcgtgggggacatcatcggcgtgctcgagcagggcaagcgcaccctgacgccccagccgatggagctgaagtactcctggaagacctgggggaaggccaagatcgtcacggccgagacccagaacagctccttcatcatcgacggccccaacacccccgagtgccccagcgcgtcccgggcctggaacgtgtgggaggtggaggactacgggttcggcgtcttcaccaccaacatctggctccgcctgcgggaggtgtacacgcagctgtgcgaccaccgcctcatgagcgccgccgtgaaggacgagcgggccgtccacgcggacatgggctactggatcgagagccagaagaacgggtcctggaagctggagaaggccagcctgatcgaggtgaagacctgcacctggccgaagtcccacaccctctggagcaacggcgtgctggagtccgacatgatcatccccaagagcctggccgggcccatctcccagcacaaccaccgcccgggctaccacacgcagaccgccgggccctggcacctcggcaagctggagctggacttcaactactgcgagggcaccaccgtcgtgatcacggagaactgcgggacccggggccccagcctccgcaccaccacggtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgcgatcctgttcgaggaggtgatgcgcgggaagttcggcaagaagcacatgatcgccggggtgttcttcaccttcgtcctgctcctgtccggccagatcacgtggcgggacatggcccacaccctgatcatgatcggcagcaacgcctccgaccgcatggggatgggcgtgacctacctcgccctgatcgcgaccttcaagatccagcccttcctggccctcgggttcttcctgcggaagctgacgagccgcgagaacctcctgctgggcgtgggcctcgccatggccaccaccctgcagctgcccgaggacatcgagcagatggcgaacgggatcgccctcggcctgatggccctgaagctcatcacccagttcgagacgtaccagctgtggaccgccctgatcagcctgacctgctccaacaccatcttcacgctgaccgtcgcctggcggaccgcgaccctgatcctcgccggggtgagcctgctgccggtctgccagtccagctccatgcgcaagacggactggctccccatggccgtggccgccatgggcgtgccgcccctcccgctgttcatcttcagcctcaaggacaccctgaagcgccggtcctggcccctgaacgagggggtcatggcggtgggcctcgtgagcatcctggcctccagcctgctccgcaacgacgtccccatggccggccccctggtggccgggggcctgctcatcgcctgctacgtgatcaccgggacctccgcggacctgacggtcgagaaggccgccgacatcacctgggaggaggaggccgagcagaccggcgtgagccacaacctgatgatcaccgtggacgacgacgggaccatgcggatcaaggacgacgagacggagaacatcctcaccgtcctgctgaagaccgccctcctgatcgtgtccggcatcttcccgtacagcatccccgcgaccctgctcgtgtggcacacgtggcagaagcagacccagcgctccggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacacgatgtggcacgtgacccgcggcgccgtgctcacctacaacgggaagcggctggagcccaactgggcctccgtcaagaaggacctgatcagctacggcgggggctggcgcctctccacccagtggcagaagggggaggaggtccaggtgatcgcggtcgagcccggcaagaaccccaagaacttccagacgatgcccggcaccttccagaccaccacgggggagatcggcgccatcgccctggacttcaagcccgggaccagcggcagccccatcatcaaccgggagggcaaggtggtggggctgtacggcaacggggtcgtgaccaagaacggcgggtacgtgtccggcatcgcccagaccaacgccgagccggacggccccacgcccgagctggaggaggagatgttcaagaagcgcaacctcaccatcatggacctgcaccccgggagcggcaagacccggaagtacctgccggcgatcgtccgcgaggccatcaagcggcgcctccggaccctgatcctggcccccacgcgcgtggtggccgccgagatggaggaggcgctcaaggggctgcccatccggtaccagaccaccgccaccaagtccgagcacacgggccgcgagatcgtcgacctgatgtgccacgccaccttcaccatgcggctcctgagccccgtgcgcgtgccgaactacaacctgatcatcatggacgaggcccacttcaccgaccccgcctccatcgcggcccgggggtacatcagcacgcgcgtcggcatgggcgaggccgccgcgatcttcatgaccgccacgccgcccgggaccgccgacgccttcccgcagtccaacgcccccatccaggacgaggagcgcgacatccccgagcggagctggaactccggcaacgagtggatcacggacttcgcggggaagaccgtgtggttcgtgcccagcatcaaggccggcaacgacatcgccaactgcctccgcaagaacgggaagaaggtcatccagctgtcccggaagaccttcgacaccgagtaccagaagacgaagctgaacgactgggacttcgtggtgaccaccgacatcagcgagatgggcgccaacttcaaggccgaccgcgtcatcgacccgcggcgctgcctcaagcccgtgatcctgaccgacggccccgagcgggtgatcctggcggggcccatgccggtcaccgccgcctccgccgcccagcgccggggccgcgtggggcggaacccccagaaggagaacgaccagtacatcttcacgggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtctggctggcccacaaggtggccagcgagggcatcaagtacacggaccggaagtggtgcttcgacgggcagcgcaacaaccagatcctggaggagaacatggacgtcgagatctggaccaaggagggcgagaagaagaagctccggccccgctggctggacgcccgcacctactccgacccgctggccctcaaggagttcaaggacttcgcggccggccgcaagagcatcgccctggacctggtgaccgagatcgggcgcgtgccctcccacctcgcccaccggacgcgcaacgccctggacaacctggtcatgctccacaccagcgagcacggcgggcgggcgtaccgccacgccgtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagacgaccaagcgcgacctgggcatgtccaaggagccgggggtggtgagccccacctcctacctggacgtcgacctccaccccgccagcgcctggaccctgtacgcggtggccacgaccgtgatcacccccatgctgcggcacaccatcgagaactccacggccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacccactacgcgatcatcggccccggcctccaggccaaggccacgcgcgaggcccagaagcggaccgccgcggggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcgcacgagctgggccctctgcgaggccctgaccctggcgaccggccccatcaccacgctctgggagggctcccccgggaagttctggaacaccaccatcgccgtgagcatggccaacatcttccggggctcctacctggccggggccggcctggcgttcagcatcatgaagtccgtcgggaccggcaagcgcggcaccgggagccagggcgagacgctcggggagaagtggaagaagaagctgaaccagctgagccggaaggagttcgacctctacaagaagtccggcatcaccgaggtggaccgcaccgaggccaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcacggaggtgcgcggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcacggggaacatcgtggcgagcgtcaacatggtgtcccgcctcctgctgaaccggttcaccatgacccaccgccggccgaccatcgagaaggacgtggacctcggcgccggcacgcgccacgtcaacgccgagcccgagacccccaacatggacgtgatcggggagcggatcaagcgcatcaaggaggagcacaacagcacctggcactacgacgacgagaacccgtacaagacctgggcctaccacggctcctacgaggtgaaggccacggggagcgcgtccagcatgatcaacggcgtcgtgaagctgctgaccaagccctgggacgtcgtgcccatggtgacccagatggccatgaccgacacgacccccttcgggcagcagcgggtcttcaaggagaaggtggacacccgcaccccgcggagcatgcccggcacgcgccgggtgatgggcatcaccgccgagtggctctggcgcaccctggggcggaacaagaagccccgcctgtgcacccgcgaggagttcacgaagaaggtccggaccaacgccgcgatgggcgccgtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacgcggatcaccgaggacgacctgcacaacgaggagaagatcacccagcagatggacccggagcaccgccagctcgccaacgccatcttcaagctgacctaccagaacaaggtcgtgaaggtgcagcggcccacccccacgggcaccgtcatggacatcatcagccgcaaggaccagcggggctccggccaggtgggcacctacgggctgaacaccttcacgaacatggaggcccagctcatccgccagatggagggcgagggggtgctgagcaaggcggacctggagaacccccacctcccggagaagaagatcacccagtggctggagaccaagggcgtcgagcggctgaagcgcatggccatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtgcccgtgcactgggtcccgacgtcccgcaccacctggagcatccacgcccaccaccagtggatgaccacggaggacatgctgaccgtgtggaaccgggtgtggatcgaggacaacccctggatggaggacaagacccccgtcaccacgtgggaggacgtgccctacctcgggaagcgcgaggaccagtggtgcggcagcctgatcgggctgacctcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10092 - RNA, 9873 nt, synthetic construct
  misc_feature 1..9873: note = derived and/or modified CDS sequence (opt1) from DENV-3__KJ189279__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggtgaccctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtcaccttcaagaacgcccacgccaagaagcaggaggtggtggtcctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtgtccgagacccagcacgggaccatcctcatcaaggtcgagtacaagggcgaggacgccccgtgcaagatccccttcagcacggaggacgggcacggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctccgcctgcgggaggtgtacacccagctgtgcgaccaccgcctcatgagcgccgccatcaaggacgagcgggccgtgcacgccgacatgggctactggatcgagagccagaagaacgggtcctggaagctggagaaggcgagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgccatcctgttcgaggaggtcatgcgcgggaagttcggcaagaagcacatgatcgcgggggtgttcttcaccttcgtgctgctcctgtccggccagatcacctggcgggacatggcccacacgctgatcatgatcggcagcaacgcctccgaccgcatggggatgggcgtcacctacctcgccctgatcgccaccttcaagatccagcccttcctggcgctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtggcctggcggaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggccgtcggcctcgtgagcatcctggcgtccagcctgctccgcaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgccaccctgctcgtgtggcacacctggcagaagcagacgcagcgctccggcgtgctgtgggacgtccccagcccgcccgagacccagaaggcggagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgccgtggagcccggcaagaaccccaagaacttccagaccatgcccggcacgttccagaccaccaccggggagatcggcgcgatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggccatcgtgcgcgaggcgatcaagcggcgcctccggaccctgatcctggcccccacccgcgtcgtggccgccgagatggaggaggccctcaaggggctgcccatccggtaccagacgaccgcgaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgccgcgcgggggtacatcagcacccgcgtgggcatgggcgaggccgccgccatcttcatgacggcgacgccgcccgggaccgccgacgccttcccgcagtccaacgcccccatccaggacgaggagcgcgacatccccgagcggagctggaactccggcaacgagtggatcaccgacttcgccgggaagacggtctggttcgtgcccagcatcaaggcgggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtggagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgccgcgggccgcaagagcatcgccctggacctggtcaccgagatcgggcgcgtgccctcccacctcgcccaccggacccgcaacgccctggacaacctggtgatgctccacacgagcgagcacggcgggcgggcctaccgccacgcggtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccacgaagcgcgacctgggcatgtccaaggagccgggggtcgtgagccccacctcctacctggacgtggacctccaccccgccagcgcctggaccctgtacgccgtcgcgaccacggtgatcacccccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgccatcatcggccccggcctccaggcgaaggccacccgcgaggcccagaagcggacggccgccgggatcatgaagaacccgaccgtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcacgatgacccaccgccggccgaccatcgagaaggacgtggacctcggcgcgggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtggtcaagctgctgacgaagccctgggacgtggtccccatggtgacccagatggcgatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgccgccatgggcgcggtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggccgacctggagaacccccacctcccggagaagaagatcacgcagtggctggagaccaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctccgcgagaccgcctgcctgggcaaggcctacgcccagatgtggagcctgatgtacttccaccggcgcgacctccggctggcgtccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10093 - RNA, 9873 nt, synthetic construct
  misc_feature 1..9873: note = derived and/or modified CDS sequence (opt1) from DENV-3__KJ189280__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcagctccgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctacagcgacccgctggccctcaaggagttcaaggacttcgccgcgggccggaagtccatcgccctggacctggtcaccgagatcgggcgcgtgcccagccacctcgcccaccggacccgcaacgccctggacaacctggtgatgctccacacgagcgagcacggcgggcgggcctaccgccacgcggtcgaggagctgcccgagaccatggagaccctgctcctgctgggcctcatgatcctgctgaccgggggcgccatgctgttcctgatctccggcaaggggatcggcaagacgagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccacgaagcgcgacctgggcatgagcaaggagccgggggtcgtgtcccccaccagctacctggacgtggacctccaccccgcctccgcctggaccctgtacgccgtcgcgaccacggtgatcacccccatgctgcggcacaccatcgagaacagcaccgccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgacgctgaccgccgccgtgctcctgctgatcacccactacgccatcatcggccccggcctccaggcgaaggccacccgcgaggcccagaagcggacggccgccgggatcatgaagaacccgaccgtggacggcatcatgaccatcgacctggaccccgtcatctacgacagcaagttcgagaagcagctgggccaggtgatgctcctggtgctgtgcgcggtccagctcctgctgatgcgcacctcctgggccctctgcgaggccctgacgctggccaccggccccatcaccaccctctgggagggcagccccgggaagttctggaacacgaccatcgcggtgtccatggccaacatcttccggggcagctacctggccggggccggcctggccttctccatcatgaagtccgtggggaccggcaagcgcggcaccgggagccagggcgagaccctcggggagaagtggaagaagaagctgaaccagctgtcccggaaggagttcgacctctacaagaagtccggcatcacggaggtcgaccgcaccgaggcgaaggaggggctgaagcggggcgagatcacccaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcaccgggaacatcgtggcctccgtgaacatggtcagccgcctcctgctgaaccggttcacgatgacccaccgccggccgaccatcgagaaggacgtggacctcggcgcgggcacccgccacgtgaacgccgagcccgagacgcccaacatggacgtcatcggggagcggatcaagcgcatcaaggaggagcacaactccacctggcactacgacgacgagaacccgtacaagacctgggcctaccacggcagctacgaggtgaaggccaccgggtccgccagcagcatgatcaacggcgtggtcaagctgctgacgaagccctgggacgtggtccccatggtgacccagatggcgatgaccgacaccacgcccttcgggcagcagcgggtgttcaaggagaaggtcgacacccgcaccccgcggtccatgcccggcacccgccgggtgatgggcatcacggccgagtggctctggcgcaccctggggcggaacaagaagccccgcctgtgcacccgcgaggagttcaccaagaaggtgcggacgaacgccgccatgggcgcggtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatctcccgcaaggaccagcggggcagcgggcaggtcggcacctacgggctgaacaccttcaccaacatggaggcccagctcatccgccagatggagggcgagggggtgctgtccaaggccgacctggagaacccccacctcccggagaagaagatcacgcagtggctggagaccaagggcgtggagcggctgaagcgcatggcgatcagcggcgacgactgcgtcgtgaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcccgcatctcccagggggcgggctggagcctccgcgagaccgcctgcctgggcaaggcctacgcccagatgtggtccctgatgtacttccaccggcgcgacctccggctggcgagcaacgccatctgctccgccgtccccgtgcactgggtgccgaccagccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggctccctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10094 - RNA, 9873 nt, synthetic construct
  misc_feature 1..9873: note = derived and/or modified CDS sequence (opt1) from DENV-3__KJ189281__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggtgctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcggaccgccaccctgatcctcgcgggggtgagcctgctgccggtctgccagtccagctccatgcgcaagaccgactggctccccatggccgtggccgccatgggcgtgccgcccctcccgctgttcatcttcagcctcaaggacacgctgaagcgccggtcctggcccctgaacgagggggtcatggccgtgggcctcgtgagcatcctggcgtccagcctgctccgcaacgacgtccccatggccggccccctggtggccgggggcctgctcatcgcctgctacgtgatcaccgggacctccgccgacctgaccgtcgagaaggcggccgacatcacgtgggaggaggaggccgagcagaccggcgtgagccacaacctgatgatcaccgtggacgacgacgggaccatgcggatcaaggacgacgagaccgagaacatcctcacggtcctgctgaagaccgccctcctgatcgtgtccggcatcttcccgtacagcatccccgccaccctgctcgtgtggcacacctggcagaagcagacgcagcgctccggcgtcctgtgggacgtgcccagcccgcccgagacccagaaggcggagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagcccaactgggcctccgtcaagaaggacctgatcagctacggcgggggctggcgcctctccacccagtggcagaagggggaggaggtccaggtgatcgccgtcgagcccggcaagaaccccaagaacttccagaccatgcccggcacgttccagaccaccaccggggagatcggcgcgatcgccctggacttcaagcccgggacgagcggcagccccatcatcaaccgggagggcaaggtggtggggctgtacggcaacggggtcgtgaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggccatcgtccgcgaggcgatcaagcggcgcctccggaccctgatcctggcccccacccgcgtggtggccgccgagatggaggaggccctcaaggggctgcccatccggtaccagacgaccgcgaccaagtccgagcacaccggccgcgagatcgtcgacctgatgtgccacgccacgttcaccatgcggctcctgagccccgtgcgcgtgccgaactacaacctgatcatcatggacgaggcccacttcaccgaccccgcctccatcgccgcgcgggggtacatcagcacccgcgtcggcatgggcgaggccgccgccatcttcatgacggcgacgccgcccgggaccgccgacgccttcccgcagtccaacgcccccatccaggacgaggagcgcgacatccccgagcggagctggaactccggcaacgagtggatcaccgacttcgccgggaagacggtgtggttcgtgcccagcatcaaggcgggcaacgacatcgccaactgcctccgcaagaacgggaagaaggtcatccagctgtcccggaagaccttcgacaccgagtaccagaagaccaagctgaacgactgggacttcgtggtgacgaccgacatcagcgagatgggcgccaacttcaaggccgaccgcgtcatcgacccgcggcgctgcctcaagcccgtgatcctgaccgacggccccgagcgggtgatcctggccgggcccatgccggtcaccgcggcctccgccgcccagcgccggggccgcgtggggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtcgagatctggacgaaggagggcgagaagaagaagctccggccccgctggctggacgcccgcacctactccgacccgctggccctcaaggagttcaaggacttcgccgcgggccgcaagagcatcgccctggacctggtgaccgagatcgggcgcgtgccctcccacctcgcccaccggacccgcaacgccctggacaacctggtcatgctccacacgagcgagcacggcgggcgggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccacgaagcgcgacctgggcatgtccaaggagccgggggtggtgagccccacctcctacctggacgtcgacctccaccccgccagcgcctggaccctgtacgccgtggcgaccacggtgatcacccccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgacgctgaccgccgccgtgctcctgctgatcacccactacgccatcatcggccccggcctccaggcgaaggccacccgcgaggcccagaagcggacggccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccgcacgatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcacgatgacccaccgccggccgaccatcgagaaggacgtggacctcggcgcgggcacccgccacgtcaacgccgagcccgagacgcccaacatggacgtgatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggcgatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgcgaggagttcaccaagaaggtccggacgaacgccgccatgggcgcggtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatcagccgcaaggaccagcggggctccggccaggtgggcacctacgggctgaacaccttcaccaacatggaggcccagctcatccgccagatggagggcgagggggtgctgagcaaggccgacctggagaacccccacctcccggagaagaagatcacgcagtggctggagaccaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccctccgcgagaccgcctgcctgggcaaggcctacgcccagatgtggagcctgatgtacttccaccggcgcgacctccggctggcgtccaacgccatctgcagcgccgtgcccgtgcactgggtcccgacctcccgcacgacctggagcatccacgcccaccaccagtggatgaccaccgaggacatgctgacggtgtggaaccgggtgtggatcgaggacaacccctggatggaggacaagacccccgtcaccacctgggaggacgtgccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10095 - RNA, 9873 nt, synthetic construct
  misc_feature 1..9873: note = derived and/or modified CDS sequence (opt1) from DENV-3__KJ189282__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcatcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtgtgggaggtcgaggactacgggttcggcgtgttcaccaccaacatctggctccgcctgcgggaggcctacacccagctgtgcgaccaccgcctcatgagcgccgccgtgaaggacgagcgggcggtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgcgggcagcgggaaggtggacaacttcaccatgggcgtcctgtgcctcgccatcctgttcgaggaggtgatgcgcgggaagttcggcaagaagcacatgatcgccggggtgttcttcaccttcgtcctgctcctgtccggccagatcacctggcgggacatggcccacacgctgatcatgatcggcagcaacgcctccgaccgcatggggatgggcgtgacctacctcgcgctgatcgccaccttcaagatccagcccttcctggccctcgggttcttcctgcggaagctgaccagccgcgagaacctcctgctgggcgtgggcctcgccatggcgacgaccctgcagctgcccgaggacatcgagcagatggccaacgggatcgccctcggcctgatggccctgaagctcatcacccagttcgagacctaccagctgtggacggccctgatcagcctgacctgctccaacaccatcttcaccctgacggtcgcgtggcggaccgccaccctgatcctcgccggggtgagcctgctgccggtgtgccagtccagctccatgcgcaagaccgactggctccccatggccgtcgccgcgatgggcgtgccgcccctcccgctgttcatcttcagcctcaaggacacgctgaagcgccggtcctggcccctgaacgagggggtcatggccgtgggcctcgtgagcatcctggcctccagcctgctccgcaacgacgtccccatggccggccccctggtggccgggggcctgctcatcgcgtgctacgtgatcaccgggacctccgccgacctgaccgtcgagaaggccgccgacatcacgtgggaggaggaggccgagcagaccggcgtgagccacaacctgatgatcaccgtggacgacgacgggaccatgcggatcaaggacgacgagaccgagaacatcctcacggtcctgctgaagaccgcgctcctgatcgtgtccggcatcttcccgtacagcatccccgccaccctgctcgtgtggcacacctggcagaagcagacgcagcgctccggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagcccaactgggcgtccgtcaagaaggacctgatcagctacggcgggggctggcgcctctccacccagtggcagaagggggaggaggtccaggtgatcgccgtcgagcccggcaagaaccccaagaacttccagaccatgcccggcacgttccagaccaccaccggggagatcggcgccatcgccctggacttcaagcccgggacgagcggcagccccatcatcaaccgggagggcaaggtggtggggctgtacggcaacggggtcgtgaccaagaacggcgggtacgtgtccggcatcgcccagaccaacgcggagccggacggccccacccccgagctggaggaggagatgttcaagaagcgcaacctcacgatcatggacctgcaccccgggagcggcaagacccggaagtacctgccggccatcgtccgcgaggccatcaagcggcgcctccggaccctgatcctggcccccacccgcgtggtggccgcggagatggaggaggccctcaaggggctgcccatccggtaccagacgaccgccaccaagtccgagcacaccggccgcgagatcgtcgacctgatgtgccacgccacgttcaccatgcggctcctgagccccgtgcgcgtgccgaactacaacctgatcatcatggacgaggcccacttcaccgaccccgcgtccatcgccgcccgggggtacatcagcacccgcgtcggcatgggcgaggccgcggccatcttcatgacggccacgccgcccgggaccgccgacgccttcccgcagtccaacgcgcccatccaggacgaggagcgcgacatccccgagcggagctggaactccggcaacgagtggatcaccgacttcgccgggaagacggtgtggttcgtgcccagcatcaaggccggcaacgacatcgccaactgcctccgcaagaacgggaagaaggtcatccagctgtcccggaagaccttcgacaccgagtaccagaagaccaagctgaacgactgggacttcgtggtgacgaccgacatcagcgagatgggcgccaacttcaaggcggaccgcgtcatcgacccgcggcgctgcctcaagcccgtgatcctgaccgacggccccgagcgggtgatcctggccgggcccatgccggtcaccgccgcctccgccgcgcagcgccggggccgcgtggggcggaacccccagaaggagaacgaccagtacatcttcaccggccagcccctcaacaacgacgaggaccacgcccactggacggaggccaagatgctgctggacaacatcaacacccccgaggggatcatcccggccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggcgctcaaggagttcaaggacttcgccgccggccgcaagagcatcgccctggacctggtcaccgagatcgggcgcgtgccctcccacctcgcccaccggacccgcaacgcgctggacaacctggtcatgctccacacgagcgagcacggcgggcgggcctaccgccacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcaccctggccgcgatcatcgccgccaacgagatgggcctgctcgagaccacgaagcgcgacctgggcatgtccaaggagccgggggtggtgagccccacctcctacctggacgtcgacctccaccccgccagcgcgtggaccctgtacgccgtggccaccacggtgatcacccccatgctgcggcacaccatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgacgctgaccgccgcggtgctcctgctgatcacccactacgccatcatcggccccggcctccaggccaaggccacccgcgaggcccagaagcggacggcggccgggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcgcaccagctgggccctctgcgaggcgctgacgctggccaccggccccatcaccaccctctgggagggctcccccgggaagttctggaacacgaccatcgccgtgagcatggccaacatcttccggggctcctacctggccggggcgggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgcgggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccgcacgatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcacgatgacccaccgccggccgaccatcgagaaggacgtggacctcggcgccggcacccgccacgtcaacgccgagcccgagacgcccaacatggacgtgatcggggagcggatcaagcgcatcaaggaggagcacaacagcacctggcactacgacgacgagaacccgtacaagacctgggcctaccacggctcctacgaggtgaaggcgaccgggagcgcctccagcatgatcaacggcgtcgtgaagctgctgacgaagccctgggacgtggtccccatggtgacccagatggccatgaccgacaccacgcccttcgggcagcagcgggtcttcaaggagaaggtggacacccgcaccccgcggagcatggccggcacccgccgggtgatgggcatcacggcggagtggctctggcgcaccctggggcggaacaagaagccccgcctgtgcacccgcgaggagttcaccaagaaggtccggacgaacgccgccatgggcgccgtgttcaccgaggagaaccagtgggactccgccaaggcggccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggcgctcgggttcctgaacgaggaccactggttcagccgggagaactcctacagcggcgtggagggggagggcctgcacaagctcggctacatcctgcgcgacatctccaagatccccgggggcgccatgtacgccgacgacaccgccgggtgggacacccggatcacggaggacgacctgcacaacgaggagaagatcacccagcagatggaccccgagcaccgccagctcgccaacgcgatcttcaagctgacctaccagaacaaggtcgtgaaggtgcagcggccgacccccaccggcacggtcatggacatcatcagccgcaaggaccagcggggctccggccaggtgggcacctacgggctgaacaccttcaccaacatggaggcccagctcatccgccagatggagggcgagggggtgctgagcaaggccgacctggagaacccccacctccccgagaagaagatcacgcagtggctggagaccaagggcgtcgagcggctgaagcgcatggccatctccggcgacgactgcgtggtgaagccgatcgacgaccggttcgccaacgcgctcctggccctgaacgacatggggaaggtccgcaaggacatcccccagtggcagcccagcaagggctggcacgactggcagcaggtccccttctgctcccaccacttccacgagctcatcatgaaggacgggcggaagctggtggtcccgtgccgcccccaggacgagctgatcggccgggcccgcatcagccagggggccggctggtccctccgcgagaccgcgtgcctgggcaaggcctacgcccagatgtggagcctgatgtacttccaccggcgcgacctccggctggcctccaacgccatctgcagcgcggtgcccgtgcactgggtccccacctcccgcacgacctggagcatccacgcccaccaccagtggatgaccaccgaggacatgctgacggtgtggaaccgggtgtggatcgaggacaacccgtggatggaggacaagacccccgtcaccacctgggaggacgtgccctacctcgggaagcgcgaggaccagtggtgcggcagcctgatcgggctgacgtcccgggccacctgggcccagaacatccccaccgccatccagcaggtccgcagcctcatcggcaacgaggagttcctggactacatgccgtccatgaagcggttccgcaaggaggaggagagcgagggggcgatctggtga

SEQ ID NO: 10096 - RNA, 9873 nt, synthetic construct
  misc_feature 1..9873: note = derived and/or modified CDS sequence (opt1) from DENV-3__KJ189283__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaagaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgtccaaggagccgggggtcgtgagccccacctcctacctggacgtggacctccaccccgccagcgcctggaccctgtacgcggtcgccaccacggtgatcacccccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggccaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggcgagcgtgaacatggtctcccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggcggacctggagaacccccacctcccggagaagaagatcacgcagtggctggagaccaagggcgtggagcggctgaagcgcatggccatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggcagcctgatcgggctgacgtcccgggcgacctgggcccagaacatcctcaccgccatccagcaggtccgcagcctgatcggcaacgaggagttcctggactacatgccgtccatgaagcggttccgcaaggaggaggagagcgagggggccatctggtga

SEQ ID NO: 10097 - RNA, 9873 nt, synthetic construct
  misc_feature 1..9873: note = derived and/or modified CDS sequence (opt1) from DENV-3__KJ189284__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggtgaccctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtcaccttcaagaacgcccacgccaagaagcaggaggtggtggtcctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtgtccgagacccagcacgggaccatcctcatcaaggtcgagtacaagggcgaggacgccccgtgcaagatccccttcagcacggaggacgggcacggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctccgcctgcgggaggtgtacacccagctgtgcgaccaccgcctcatgagcgccgccgtgaaggacgagcgggccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgttcttcaccttcgtcctgctcctgtccggccagatcacctggcgggacatggcccacacgctgatcatgatcggcagcaacgcctccgaccgcatggggatgggcgtgacctacctcgccctgatcgccaccttcaagatccagcccttcctggcgctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcggaccgccaccctgatcctcgcgggggtgagcctgctgccggtctgccagtccagctccatgcgcaagaccgactggctccccatggccgtggccgccatgggcgtgccgcccctcccgctgttcatcttcagcctcaaggacacgctgaagcgccggtcctggcccctgaacgagggggtcatggccgtgggcctcgtgagcatcctggcgtccagcctgctccgcaacgacgtccccatggccggccccctggtggccgggggcctgctcatcgcctgctacgtgatcaccgggacctccgccgacctgaccgtcgagaaggcggccgacatcacgtgggaggaggaggccgagcagaccggcgtgagccacaacctgatgatcaccgtggacgacgacgggaccatgcggatcaaggacgacgagaccgagaacatcctcacggtcctgctgaagaccgccctcctgatcgtgtccggcatcttcccgtacagcatccccgccaccctgctcgtgtggcacacctggcagaagcagacgcagcgctccggcgtcctgtgggacgtgcccagcccgcccgagacccagaaggcggagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagcccaactgggcctccgtcaagaaggacctgatcagctacggcgggggctggcgcctctccacccagtggcagaagggggaggaggtccaggtgatcgccgtcgagcccggcaagaaccccaagaacttccagaccatgcccggcacgttccagaccaccaccggggagatcggcgcgatcgccctggacttcaagcccgggacgagcggcagccccatcatcaaccgggagggcaaggtggtggggctgtacggcaacggggtcgtgaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggccatcgtccgcgaggcgatcaagcggcgcctccggaccctgatcctggcccccacccgcgtggtggccgccgagatggaggaggccctcaaggggctgcccatccggtaccagacgaccgcgaccaagtccgagcacaccggccgcgagatcgtcgacctgatgtgccacgccacgttcaccatgcggctcctgagccccgtgcgcgtgccgaactacaacctgatcatcatggacgaggcccacttcaccgaccccgcctccatcgccgcgcgggggtacatcagcacccgcgtcggcatgggcgaggccgccgccatcttcatgacggcgacgccgcccgggaccgccgacgccttcccgcagtccaacgcccccatccaggacgaggagcgcgacatccccgagcggagctggaactccggcaacgagtggatcaccgacttcgccgggaagacggtgtggttcgtgcccagcatcaaggcgggcaacgacatcgccaactgcctccgcaagaacgggaagaaggtcatccagctgtcccggaagaccttcgacaccgagtaccagaagaccaagctgaacgactgggacttcgtggtgacgaccgacatcagcgagatgggcgccaacttcaaggccgaccgcgtcatcgacccgcggcgctgcctcaagcccgtgatcctgaccgacggccccgagcgggtgatcctggccgggcccatgccggtcaccgcggcctccgccgcccagcgccggggccgcgtggggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtcgagatctggacgaaggagggcgagaagaagaagctccggccccgctggctggacgcccgcacctactccgacccgctggccctcaaggagttcaaggacttcgccgcgggccgcaagagcatcgccctggacctggtgaccgagatcgggcgcgtgccctcccacctcgcccaccggacccgcaacgccctggacaacctggtcatgctccacacgagcgagcacggcgggcgggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccacgaagcgcgacctgggcatgtccaaggagccgggggtggtgagccccacctcctacctggacgtcgacctccaccccgccagcgcctggaccctgtacgccgtggcgaccacggtgatcacccccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgacgctgaccgccgccgtgctcctgctgatcacccactacgccatcatcggccccggcctccaggcgaaggccacccgcgaggcccagaagcggacggccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccgcacgatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcacgatgacccaccgccggccgaccatcgagaaggacgtggacctcggcgcgggcacccgccacgtcaacgccgagcccgagacgcccaacatggacgtgatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggcgatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgcgaggagttcaccaagaaggtccggacgaacgccgccatgggcgcggtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatcagccgcaaggaccagcggggctccggccaggtgggcacctacgggctgaacaccttcaccaacatggaggcccagctcatccgccagatggagggcgagggggtgctgagcaaggccgacctggagaacccccacctcccggagaagaagatcacgcagtggctggagaccaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccctccgcgagaccgcctgcctgggcaaggcctacgcccagatgtggagcctgatgtacttccaccggcgcgacctccggctggcgtccaacgccatctgcagcgccgtgcccgtgcactgggtcccgacctcccgcacgacctggagcatccacgcccaccaccagtggatgaccaccgaggacatgctgacggtgtggaaccgggtgtggatcgaggacaacccctggatggaggacaagacccccgtcaccacctgggaggacgtgccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10098 - RNA, 9873 nt, synthetic construct
  misc_feature 1..9873: note = derived and/or modified CDS sequence (opt1) from DENV-3__KJ189286__SS-prME
  source 1..9873: mol_type = other RNA
accagcttctgcctgatgatgatcctccccgcggccctggcgttccacctgaccagccgggacggggagccgcggatgatcgtggggaagaacgagcgcggcaagagcctcctgttcaagaccgccagcgggatcaacatgtgcaccctgatcgccatggacctcggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctggcgccccacgtgggcatggggctcgacacccgcacccagacctggatgagcgccgagggcgcctggcgccaggtggagaaggtcgagacgtgggccctgcgccacccggggttcaccatcctggccctcttcctggcccactacatcggcacctccctgacccagaaggtggtgatcttcatcctcctgatgctggtcacgcccagcatgaccatgcggtgcgtgggggtgggcaaccgcgacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcggaagctctgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctgttcgggaagggctccctcgtgacctgcgccaagttccagtgcctggagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgaccctccccgagtacggcaccctggggctggagtgctccccgcgcacgggcctcgacttcaacgagatgatcctgctgaccatgaagaacaaggcctggatggtgcaccggcagtggttcttcgacctccccctgccctggaccagcggcgccaccacggagacccccacctggaaccgcaaggagctgctcgtgaccttcaagaacgcccacgccaagaagcaggaggtcgtggtgctggggtcccaggagggcgcgatgcacacggccctgaccggggccaccgagatccagaacagcggcgggacctccatcttcgccggccacctcaagtgccggctgaagatggacaagctggagctcaagggcatgagctacgccatgtgcacgaacaccttcgtcctgaagaaggaggtgtccgagacccagcacgggaccatcctgatcaaggtggagtacaagggcgaggacgcgccgtgcaagatccccttcagcacggaggacgggcacggcaaggcccacaacggccgcctcatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctgaacagcctcggcaagatggtccaccagatcttcgggtccgcctacaccgccctgttcagcggcgtgtcctgggtgatgaagatcggcatcggggtcctgctcacctggatcggcctgaacagcaagaacacctccatgagcttctcctgcatcgccatcgggatcatcacgctgtacctcggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctggccacggccatcgccggcgcgtgggagaacggggtctgcggcatccgcagcaccacccggatggagaacctcctgtggaagcagatcgccaacgagctgaactacatcctctgggagaacaacatcaagctgaccgtggtggtcggggacatcatcggcgtgctggagcagggcaagcgcacgctcacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctgcgcctccgggaggtctacacccagctgtgcgaccaccgcctgatgagcgccgccgtgaaggacgagcgggccgtgcacgcggacatgggctactggatcgagagccagaagaacgggtcctggaagctcgagaaggccagcctgatcgaggtcaagacgtgcacctggccgaagtcccacaccctgtggagcaacggcgtgctcgagtccgacatgatcatccccaagagcctggccgggcccatctcccagcacaaccaccgcccgggctaccacacccagacggccgggccctggcacctgggcaagctcgagctggacttcaactactgcgagggcaccaccgtggtcatcaccgagaactgcgggacgcggggccccagcctgcgcaccaccaccgtgtccgggaagctcatccacgagtggtgctgccggagctgcacgctgcccccgctgcgctacatgggcgaggacgggtgctggtacggcatggagatccggcccatctccgagaaggaggagaacatggtgaagtccctcgtctccgccggcagcgggaaggtggacaacttcaccatgggcgtgctgtgcctggcgatcctcttcgaggaggtcatgcgcgggaagttcggcaagaagcacatgatcgccggggtgttcttcaccttcgtgctgctgctctccggccagatcacctggcgggacatggcccacacgctgatcatgatcggcagcaacgcctccgaccgcatggggatgggcgtcacctacctggccctcatcgcgaccttcaagatccagcccttcctggccctggggttcttcctccggaagctgaccagccgcgagaacctgctcctgggcgtgggcctggccatggccacgaccctccagctgcccgaggacatcgagcagatggcgaacgggatcgccctgggcctcatggccctgaagctgatcacccagttcgagacctaccagctctggacggccctgatcagcctgacctgctccaacaccatcttcaccctcacggtggcctggcggaccgcgaccctgatcctggccggggtcagcctcctgccggtgtgccagtccagctccatgcgcaagaccgactggctgcccatggccgtcgccgccatgggcgtgccgcccctcccgctgttcatcttcaacctgaaggacacgctcaagcgccggagctggcccctgaacgagggggtgatggcggtcggcctggtgtccatcctcgccagctccctgctgcgcaacgacgtgcccatggccggccccctcgtcgccgggggcctgctgatcgcctgctacgtgatcaccgggaccagcgcggacctcaccgtggagaaggccgccgacatcacgtgggaggaggaggccgagcagaccggcgtctcccacaacctgatgatcaccgtggacgacgacgggaccatgcggatcaaggacgacgagaccgagaacatcctgacggtgctcctgaagaccgccctgctcatcgtcagcggcatcttcccgtactccatccccgcgaccctgctggtgtggcacacctggcagaagcagacgcagcgcagcggcgtgctctgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctgacctacaacgggaagcggctcgagcccaactgggccagcgtgaagaaggacctgatctcctacggcgggggctggcgcctgagcacccagtggcagaagggggaggaggtccaggtgatcgcggtggagcccggcaagaaccccaagaacttccagaccatgcccggcacgttccagaccaccaccggggagatcggcgccatcgccctcgacttcaagcccgggacgtccggcagccccatcatcaaccgggagggcaaggtcgtggggctgtacggcaacggggtggtcaccaagaacggcgggtacgtgagcggcatcgcccagaccaacgccgagccggacggccccacccccgagctggaggaggagatgttcaagaagcgcaacctgacgatcatggacctccaccccgggtccggcaagacccggaagtacctgccggcgatcgtgcgcgaggccatcaagcggcgcctgcggaccctcatcctggcccccacccgcgtcgtggccgccgagatggaggaggcgctgaaggggctccccatccggtaccagacgaccgccaccaagagcgagcacaccggccgcgagatcgtggacctgatgtgccacgccacgttcaccatgcggctgctctcccccgtccgcgtgccgaactacaacctgatcatcatggacgaggcccacttcaccgaccccgccagcatcgcggcccgggggtacatctccacccgcgtgggcatgggcgaggccgccgcgatcttcatgacggccacgccgcccgggaccgccgacgccttcccgcagagcaacgcccccatccaggacgaggagcgcgacatccccgagcggtcctggaacagcggcaacgagtggatcaccgacttcgcggggaagacggtctggttcgtgccctccatcaaggccggcaacgacatcgccaactgcctgcgcaagaacgggaagaaggtgatccagctcagccggaagaccttcgacaccgagtaccagaagaccaagctgaacgactgggacttcgtcgtgacgaccgacatctccgagatgggcgccaacttcaaggccgaccgcgtgatcgacccgcggcgctgcctgaagcccgtcatcctcaccgacggccccgagcgggtgatcctggcggggcccatgccggtgaccgccgccagcgccgcccagcgccggggccgcgtcgggcggaacccccagaaggagaacgaccagtacatcttcaccggccagcccctgaacaacgacgaggaccacgcgcactggacggaggccaagatgctcctggacaacatcaacacccccgaggggatcatcccggccctgttcgagcccgagcgcgagaagtccgccgcgatcgacggcgagtaccggctcaagggcgagagccgcaagaccttcgtggagctgatgcggcgcggggacctgcccgtgtggctcgcccacaaggtcgcctccgagggcatcaagtacaccgaccggaagtggtgcttcgacgggcagcgcaacaaccagatcctggaggagaacatggacgtggagatctggacgaaggagggcgagaagaagaagctgcggccccgctggctcgacgcccgcacctacagcgacccgctggccctgaaggagttcaaggacttcgcggccggccggaagtccatcgccctcgacctggtcaccgagatcgggcgcgtgcccagccacctggcccaccggacccgcaacgccctcgacaacctggtgatgctgcacacgtccgagcacggcgggcgggcgtaccgccacgccgtcgaggagctccccgagaccatggagaccctgctgctcctgggcctgatgatcctcctgaccgggggcgccatgctgttcctcatcagcggcaaggggatcggcaagacgagcatcgggctgatctgcgtgatcgcctccagcggcatgctgtggatggccgagatcccgctccagtggatcgcgtccgccatcgtgctggagttcttcatgatggtcctgctcatccccgagcccgagaagcagcggacgccccaggacaaccagctggcctacgtggtgatcgggatcctgaccctcgccgccatcatcgcggccaacgagatgggcctgctggagaccacgaagcgcgacctcggcatgagcaaggagccgggggtcgtgtcccccaccagctacctggacgtggacctgcaccccgcctccgcctggaccctctacgcggtcgccaccacggtgatcacccccatgctgcggcacaccatcgagaacagcaccgccaacgtgtccctggccgccatcgcgaaccaggccgtcgtgctcatgggcctggacaaggggtggccgatcagcaagatggacctgggcgtgcccctcctggccctggggtgctactcccaggtcaaccccctcacgctgaccgccgccgtgctgctcctgatcacccactacgcgatcatcggccccggcctgcaggccaaggccacccgcgaggcccagaagcggacggccgcggggatcatgaagaacccgaccgtggacggcatcatgaccatcgacctcgaccccgtcatctacgacagcaagttcgagaagcagctgggccaggtgatgctgctcgtgctgtgcgccgtccagctgctcctgatgcgcacctcctgggccctgtgcgaggccctcacgctggcgaccggccccatcaccaccctgtgggagggcagccccgggaagttctggaacacgaccatcgccgtgtccatggccaacatcttccggggcagctacctcgccggggccggcctggcgttctccatcatgaagtccgtggggaccggcaagcgcggcaccgggtcccagggcgagaccctgggggagaagtggaagaagaagctcaaccagctgagccggaaggagttcgacctgtacaagaagtccggcatcacggaggtcgaccgcaccgaggccaaggaggggctcaagcggggcgagatcacccaccacgccgtgtcccgcggcagcgccaagctgcagtggttcgtggagcggaacatggtcatcccggaggggcgcgtgatcgacctgggctgcgggcggggcgggtggtcctactactgcgccggcctcaagaaggtgaccgaggtccgcggctacacgaagggcgggcccgggcacgaggagcccgtgcccatgagcacctacggctggaacatcgtgaagctgatgtccgggaaggacgtcttctacctgccgcccgagaagtgcgacaccctcctgtgcgacatcggcgagagctcccccagccccaccgtggaggagtcccgcacgatccgggtgctgaagatggtcgagccgtggctgaagaacaaccagttctgcatcaaggtgctcaacccctacatgcccaccgtgatcgagcacctggagcgcctgcagcggaagcacggcgggatgctcgtccgcaaccccctgagccggaactccacccacgagatgtactggatcagcaacggcaccgggaacatcgtggcgtccgtgaacatggtcagccgcctgctcctgaaccggttcacgatgacccaccgccggccgaccatcgagaaggacgtggacctgggcgccggcacccgccacgtgaacgccgagcccgagacgcccaacatggacgtcatcggggagcggatcaagcgcatcaaggaggagcacaactccacctggcactacgacgacgagaacccgtacaagacctgggcctaccacggcagctacgaggtgaaggccaccgggtccgcgagctccatgatcaacggcgtggtcaagctcctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctgtggcgcaccctcgggcggaacaagaagccccgcctgtgcacccgcgaggagttcaccaagaaggtgcggacgaacgccgcgatgggcgccgtcttcaccgaggagaaccagtgggacagcgccaaggccgccgtggaggacgaggacttctggaagctggtggaccgcgagcgggagctccacaagctggggaagtgcggctcctgcgtctacaacatgatggggaagcgcgagaagaagctgggcgagttcggcaaggcgaaggggagccgggccatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccgggggcgccatgtacgcggacgacaccgccgggtgggacacccggatcacggaggacgacctgcacaacgaggagaagatcacccagcagatggacccggagcaccgccagctggccaacgccatcttcaagctcacctaccagaacaaggtggtcaaggtgcagcggcccacccccaccggcacggtgatggacatcatctcccgcaaggaccagcggggcagcgggcaggtcggcacctacgggctgaacaccttcaccaacatggaggcccagctgatccgccagatggagggcgagggggtgctctccaaggcggacctggagaacccccacctccccgagaagaagatcacgcagtggctggagaccaagggcgtggagcggctgaagcgcatggccatcagcggcgacgactgcgtcgtgaagcccatcgacgaccggttcgccaacgccctgctcgccctgaacgacatggggaaggtgcgcaaggacatcccccagtggcagccctccaagggctggcacgactggcagcaggtcccgttctgcagccaccacttccacgagctgatcatgaaggacgggcggaagctcgtggtgccctgccgcccccaggacgagctgatcggccgggcgcgcatctcccagggggccggctggagcctgcgcgagaccgcctgcctcggcaaggcctacgcgcagatgtggtccctgatgtacttccaccggcgcgacctgcggctcgccagcaacgccatctgctccgccgtccccgtgcactgggtgccgaccagccgcacgacctggtccatccacgcccaccaccagtggatgaccaccgaggacatgctgacggtctggaaccgggtgtggatcgaggacaacccctggatggaggacaagacccccgtgaccacctgggaggacgtcccctacctggggaagcgcgaggaccagtggtgcggcagcctcatcgggctgacgagccgggcgacctgggcccagaacatcccgaccgccatccagcaggtccgctccctgatcggcaacgaggagttcctcgactacatgcccagcatgaagcggttccgcaaggaggaggagtccgagggggccatctggtga

SEQ ID NO: 10099 - RNA, 9873 nt, synthetic construct
  misc_feature 1..9873: note = derived and/or modified CDS sequence (opt1) from DENV-3__KJ189287__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcatcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtgtgggaggtcgaggactacgggttcggcgtgttcaccaccaacatctggctccgcctgcgggaggtgtacacccagctgtgcgaccaccgcctcatgagcgccgccgtcaaggacgagcgggccgtgcacgcggacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtgatcaccgagaactgcgggacgcggggccccagcctccgcaccaccaccgtctccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtcgacaacttcaccatgggcgtgctgtgcctcgcgatcctgttcgaggaggtgatgcgcgggaagttcggcaagaagcacatgatcgccggggtcttcttcaccttcgtgctgctcctgtccggccagatcacctggcggaacatggcccacacgctgatcatgatcggcagcaacgcctccgaccgcatggggatgggcgtgacctacctcgccctgatcgcgaccttcaagatccagcccttcctggtcctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtggcctggcggaccgccaccctgatcctcgcgggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggccgtcggcctcgtgagcatcctggcgtccagcctgctccgcaacgacgtgcccatggccggccccctggtcgccgggggcctgctcatcgcctgctacgtgatcaccgggacctccgccgacctgaccgtggagaaggcggccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgccaccctgctcgtgtggcacacctggcagaagcagacgcagcgctccggcgtgctgtgggacgtccccagcccgcccgagacccagaaggcggagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgccgtggagcccggcaagaaccccaagaacttccagaccatgcccggcacgttccagaccaccaccggggagatcggcgcgatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggccatcgtgcgcgaggcgatcaagcggcgcctccggaccctgatcctggcccccacccgcgtcgtggccgccgagatggaggaggccctcaaggggctgcccatccggtaccagacgaccgcgaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgccgcgcgggggtacatcagcacccgcgtgggcatgggcgaggccgccgccatcttcatgacggcgacgccgcccgggaccgccgacgccttcccgcagtccaacgcccccatccaggacgaggagcgcgacatccccgagcggagctggaactccggcaacgagtggatcaccgacttcgccgggaagacggtctggttcgtgcccagcatcaaggcgggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtggagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgccgcgggccgcaagagcatcgccctggacctggtcaccgagatcgggcgcgtgccctcccacctcgcccaccggacccgcaacgccctggacaacctggtgatgctccacacgagcgagcacggcgggcgggcctaccgccacgcggtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccacgaagcgcgacctgggcatgtccaaggagccgggggtcgtgagccccacctcctacctggacgtggacctccaccccgccagcgcctggaccctgtacgccgtcgcgaccacggtgatcacccccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgccatcatcggccccggcctccaggcgaaggccacccgcgaggcccagaagcggacggccgccgggatcatgaagaacccgaccgtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcacgatgacccaccgccggccgaccatcgagaaggacgtggacctcggcgcgggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtggtcaagctgctgacgaagccctgggacgtggtccccatggtgacccagatggcgatgaccgacaccacgcccttcgggcagcagcgggtgttcaaggagaaggtcgacacccgcaccccgcggagcatggccggcacccgccgggtgatgggcatcacggccgagtggctctggcgcaccctggggcggaacaagaagccccgcctgtgcacccgcgaggagttcaccaagaaggtgcggacgaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggaccccgagcaccgccagctcgccaacgccatcttcaagctgacctaccagaacaaggtggtcaaggtgcagcggccgacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggcggacctggagaacccccacctccccgagaagaagatcacgcagtggctggagaccaagggcgtggagcggctgaagcgcatggccatctccggcgacgactgcgtcgtgaagccgatcgacgaccggttcgccaacgccctcctggccctgaacgacatggggaaggtgcgcaaggacatcccccagtggcagcccagcaagggctggcacgactggcagcaggtccccttctgctcccaccacttccacgagctcatcatgaaggacgggcggaagctggtggtgccgtgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgcccacctcccgcacgacctggagcatccacgcccaccaccagtggatgaccaccgaggacatgctgacggtctggaaccgggtgtggatcgaggacaacccgtggatggaggacaagacccccgtgaccacctgggaggacgtcccctacctcgggaagcgcgaggaccagtggtgcggcagcctgatcgggctgacgtcccgggcgacctgggcccagaacatccccaccgccatccagcaggtccgcagcctcatcggcaacgaggagttcctggactacatgccgtccatgaagcggttccgcaaggaggaggagagcgagggggccatctggtga

SEQ ID NO: 10100 - RNA, 9873 nt, synthetic construct
  misc_feature 1..9873: note = derived and/or modified CDS sequence (opt1) from DENV-3__KJ189288__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgcctccgggaccaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacgtggatgagcgccgagggcgcctggcggcaggtcgagaaggtcgagacctgggccctgcgccacccggggttcaccatcctcgcgctgttcctggcccactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaagatggtccagtacgagaacctcaagtacacggtgatcatcaccgtgcacaccggggaccagcaccaggtcggcaacgagacccagggggtgacggccgagatcacgccccaggccagcaccaccgaggcgaccctgcccgagtacggcacgctggggctcgagtgctccccgcgcaccggcctggacttcaacgagatgatcctgctcaccatgaagaacaaggcctggatggtccaccggcagtggttcttcgacctgcccctgccctggaccagcggcgccacgaccgagacccccacctggaaccgcaaggagctcctggtgacgttcaagaacgcccacgccaagaagcaggaggtggtcgtgctggggtcccaggagggcgcgatgcacaccgccctcaccggggccaccgagatccagaacagcggcgggacgtccatcttcgccggccacctgaagtgccggctgaagatggacaagctcgagctgaagggcatgagctacgccatgtgcaccaacaccttcgtgctgaagaaggaggtctccgagacccagcacgggacgatcctcatcaaggtggagtacaagggcgaggacgcgccgtgcaagatccccttcagcaccgaggacgggcacggcaaggcccacaacggccgcctgatcaccgccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccacggcccggggcgcccgccggatggccatcctgggcgacaccgcgtgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacctggatcggcctgaacagcaagaacacgtccatgagcttctcctgcatcgccatcgggatcatcaccctctacctgggcgccgtcgtgcaggcggacatggggtgcgtgatcaactggaagggcaaggagctgaagtgcggcagcgggatcttcgtcaccaacgaggtgcacacctggacggagcagtacaagttccaggccgactcccccaagcgcctcgccaccgccatcgccggcgcgtgggagaacggggtgtgcggcatccgcagcaccacccggatggagaacctgctgtggaagcagatcgccaacgagctcaactacatcctgtgggagaacaacgtcaagctgacggtggtggtcggggacatcatcggcgtgctcgagcagggcaagcgcaccctgacgccccagccgatggagctgaagtactcctggaagacctgggggaaggccaagatcgtgacggccgagacccagaacagctccttcatcatcgacggccccaacacccccgagtgccccagcgcgtcccgggcctggaacgtctgggaggtggaggactacgggttcggcgtgttcaccaccaacatctggctccgcctgcgggaggcctacacgcagctgtgcgaccaccgcctcatgagcgccgccgtcaaggacgagcgggcggtgcacgccgacatgggctactggatcgagagccagaagaacgggtcctggaagctggagaaggccagcctgatcgaggtgaagacctgcacctggccgaagtcccacaccctctggagcaacggcgtcctggagtccgacatgatcatccccaagagcctggccgggcccatctcccagcacaaccaccgcccgggctaccacacgcagaccgccgggccctggcacctcggcaagctggagctggacttcaactactgcgagggcaccaccgtggtgatcacggagaactgcgggacccggggccccagcctccgcaccaccacggtctccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgcgggcagcgggaaggtcgacaacttcaccatgggcgtgctgtgcctcgccatcctgttcgaggaggtgatgcgcgggaagttcggcaagaagcacatgatcgccggggtcttcttcaccttcgtgctgctcctgtccggccagatcacgtggcgggacatggcccacaccctgatcatgatcggcagcaacgcctccgaccgcatggggatgggcgtgacctacctcgcgctgatcgccaccttcaagatccagcccttcctggccctcgggttcttcctgcggaagctgacgagccgcgagaacctcctgctgggcgtcggcctcgccatggcgaccaccctgcagctgcccgaggacatcgagcagatggccaacgggatcgccctcggcctgatggccctgaagctcatcacccagttcgagacgtaccagctgtggaccgccctgatcagcctgacctgctccaacaccatcttcacgctgaccgtggcgtggcggaccgccaccctgatcctcgccggggtgagcctgctgccggtctgccagtccagctccatgcgcaagacggactggctccccatggccgtggccgcgatgggcgtgccgcccctcccgctgttcatcttcagcctcaaggacaccctgaagcgccggtcctggcccctgaacgagggggtgatggccgtgggcctcgtcagcatcctggcctccagcctgctccgcaacgacgtgcccatggccggccccctggtggccgggggcctgctcatcgcgtgctacgtcatcaccgggacctccgccgacctgacggtggagaaggccgccgacatcacctgggaggaggaggccgagcagaccggcgtgagccacaacctgatgatcaccgtcgacgacgacgggaccatgcggatcaaggacgacgagacggagaacatcctcaccgtgctgctgaagaccgcgctcctgatcgtgtccggcatcttcccgtacagcatccccgccaccctgctcgtctggcacacgtggcagaagcagacccagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacacgatgtggcacgtgacccgcggcgccgtcctcacctacaacgggaagcggctggagcccaactgggcgtccgtgaagaaggacctgatcagctacggcgggggctggcgcctctccacccagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgggagggcaaggtggtcgggctgtacggcaacggggtggtgaccaagaacggcgggtacgtctccggcatcgcccagaccaacgcggagccggacggccccacgcccgagctggaggaggagatgttcaagaagcgcaacctcaccatcatggacctgcaccccgggagcggcaagacccggaagtacctgccggccatcgtgcgcgaggccatcaagcggcgcctccggaccctgatcctggcccccacgcgcgtggtcgccgcggagatggaggaggccctcaaggggctgcccatccggtaccagaccaccgccaccaagtccgagcacacgggccgcgagatcgtggacctgatgtgccacgccaccttcaccatgcggctcctgagccccgtgcgcgtcccgaactacaacctgatcatcatggacgaggcccacttcaccgaccccgcgtccatcgccgcccgggggtacatcagcacgcgcgtgggcatgggcgaggccgcggccatcttcatgaccgccacgccgcccgggaccgccgacgccttcccgcagtccaacgcgcccatccaggacgaggagcgcgacatccccgagcggagctggaactccggcaacgagtggatcacggacttcgccgggaagaccgtgtggttcgtccccagcatcaaggccggcaacgacatcgccaactgcctccgcaagaacgggaagaaggtgatccagctgtcccggaagaccttcgacaccgagtaccagaagacgaagctgaacgactgggacttcgtggtcaccaccgacatcagcgagatgggcgccaacttcaaggcggaccgcgtgatcgacccgcggcgctgcctcaagcccgtgatcctgaccgacggccccgagcgggtcatcctggccgggcccatgccggtgaccgccgcctccgccgcgcagcgccggggccgcgtggggcggaacccccagaaggagaacgaccagtacatcttcacgggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagaccttcgtcgagctgatgcggcgcggggacctccccgtgtggctggcccacaaggtggccagcgagggcatcaagtacacggaccggaagtggtgcttcgacgggcagcgcaacaaccagatcctggaggagaacatggacgtcgagatctggaccaaggagggcgagaagaagaagctccggccccgctggctggacgcccgcacctactccgacccgctggcgctcaaggagttcaaggacttcgccgccggccgcaagagcatcgccctggacctggtgaccgagatcgggcgcgtcccctcccacctcgcccaccggacgcgcaacgcgctggacaacctggtgatgctccacaccagcgagcacggcgggcgggcctaccgccacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggcggagatcccgctgcagtggatcgccagcgccatcgtgctggagttcttcatgatggtgctcctggtccccgagcccgagaagcagcggacgccccaggacaaccagctggcctacgtggtgatcgggatcctcaccctggccgcgatcatcgccgccaacgagatgggcctgctcgagacgaccaagcgcgacctgggcatgtccaaggagccgggggtcgtgagccccacctcctacctggacgtggacctccaccccgccagcgcgtggaccctgtacgccgtcgccacgaccgtgatcacccccatgctgcggcacaccatcgagaactccacggccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacccactacgccatcatcggccccggcctccaggccaaggccacgcgcgaggcccagaagcggaccgcggccgggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcacgagctgggccctctgcgaggcgctgaccctggccaccggccccatcaccacgctctgggagggctcccccgggaagttctggaacaccaccatcgccgtgagcatggccaacatcttccggggctcctacctggccggggcgggcctggccttcagcatcatgaagtccgtggggaccggcaagcgcggcaccgggagccagggcgagacgctcggggagaagtggaagaagaagctgaaccagctgagccggaaggagttcgacctctacaagaagtccggcatcaccgaggtcgaccgcaccgaggccaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgcgggcctgaagaaggtgacggaggtccgcggctacaccaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccacggtggaggagagccgcaccatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcacggggaacatcgtggccagcgtgaacatggtctcccgcctcctgctgaaccggttcaccatgacccaccgccggccgaccatcgagaaggacgtggacctcggcgccggcacgcgccacgtgaacgccgagcccgagacccccaacatggacgtcatcggggagcggatcaagcgcatcaaggaggagcacaacagcacctggcactacgacgacgagaacccgtacaagacctgggcctaccacggctcctacgaggtgaaggcgacggggagcgcctccagcatgatcaacggcgtggtcaagctgctgaccaagccctgggacgtggtccccatggtgacccagatggccatgaccgacacgacccccttcgggcagcagcgggtgttcaaggagaaggtcgacacccgcaccccgcggagcatgcccggcacgcgccgggtgatgggcatcaccgccgagtggctctggcgcaccctggggcggaacaagaagccccgcctgtgcacccgcgaggagttcacgaagaaggtgcggaccaacgcggccatgggcgccgtcttcaccgaggagaaccagtgggactccgccaaggccgcggtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgcgatgtacgccgacgacaccgccgggtgggacacgcggatcaccgaggacgacctgcacaacgaggagaagatcacccagcagatggacccggagcaccgccagctcgccaacgccatcttcaagctgacctaccagaacaaggtggtcaaggtgcagcggcccacccccacgggcaccgtgatggacatcatcagccgcaaggaccagcggggctccgggcaggtcggcacctacgggctgaacaccttcacgaacatggaggcgcagctcatccgccagatggagggcgagggggtgctgagcaaggccgacctggagaacccccacctcccggagaagaagatcacccagtggctggagaccaagggcgtggagcggctgaagcgcatggccatctccggcgacgactgcgtcgtgaagcccatcgacgaccggttcgccaacgccctcctggcgctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctccgcgagaccgcctgcctgggcaaggcgtacgcccagatgtggagcctgatgtacttccaccggcgcgacctccggctggcctccaacgccatctgcagcgccgtccccgtgcactgggtgccgacgtcccgcaccacctggagcatccacgcgcaccaccagtggatgaccacggaggacatgctgaccgtctggaaccgggtgtggatcgaggacaacccctggatggaggacaagacccccgtgaccacgtgggaggacgtcccctacctcgggaagcgcgaggaccagtggtgcggcagcctgatcgggctgacctcccgggccacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10101 - RNA, 9873 nt, synthetic construct
  misc_feature 1..9873: note = derived and/or modified CDS sequence (opt1) from DENV-3__KJ189289__SS-prME
  source 1..9873: mol_type = other RNA
accagcctctgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacacgatcggcgtgctcgagcagggcaagcgcaccctgacgccccagccgatggagctgaagtactcctggaagacctgggggaaggccaagatcgtgacggccgagacccagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacgcagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacctgcacctggccgaagtcccacaccctctggagcaacggcgtgctggagtccgacatgatcatccccaagagcctggccgggcccatctcccagcacaaccaccgcccgggctaccacacgcagaccgccgggccctggcacctcggcaagctggagctggacttcaactactgcgagggcaccaccgtggtcatcacggagaactgcgggacccggggccccagcctccgcaccaccacggtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacgtggcgggacatggcccacaccctgatcatgatcggcagcaacgcctccgaccgcatggggatgggcgtcacctacctcgccctgatcgcgaccttcaagatccagcccttcctggccctcgggttcttcctgcggaagctgacgagccgcgagaacctcctgctgggcgtgggcctcgccatggccaccaccctgcagctgcccgaggacatcgagcagatggcgaacgggatcgccctcggcctgatggccctgaagctcatcacccagttcgagacgtaccagctgtggaccgccctgatcagcctgacctgctccaacaccatcttcacgctgaccgtggcctggcggaccgcgaccctgatcctcgccggggtcagcctgctgccggtgtgccagtccagctccatgcgcaagacggactggctccccatggccgtcgccgccatgggcgtgccgcccctcccgctgttcatcttcagcctcaaggacaccctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgacggtggagaaggccgccgacatcacctgggaggaggaggccgagcagaccggcgtcagccacaacctgatgatcaccgtggacgacgacgggaccatgcggatcaaggacgacgagacggagaacatcctcaccgtgctgctgaagaccgccctcctgatcgtctccggcatcttcccgtacagcatccccgcgaccctgctcgtgtggcacacgtggcagaagcagacccagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacacgatgtggcacgtcacccgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagacgatgcccggcaccttccagaccaccacgggggagatcggcgccatcgccctggacttcaagcccgggaccagcggcagccccatcatcaaccgggagggcaaggtcgtggggctgtacggcaacggggtggtcaccaagaacggcgggtacgtgtccggcatcgcccagaccaacgccgagccggacggccccacgcccgagctggaggaggagatgttcaagaagcgcaacctcaccatcatggacctgcaccccgggagcggcaagacccggaagtacctgccggcgatcgtgcgcgaggccatcaagcggcgcctccggaccctgatcctggcccccacgcgcgtcgtggccgccgagatggaggaggcgctcaaggggctgcccatccggtaccagaccaccgccaccaagtccgagcacacgggccgcgagatcgtggacctgatgtgccacgccaccttcaccatgcggctcctgagccccgtccgcgtgccgaactacaacctgatcatcatggacgaggcccacttcaccgaccccgcctccatcgcggcccgggggtacatcagcacgcgcgtgggcatgggcgaggccgccgcgatcttcatgaccgccacgccgcccgggaccgccgacgccttcccgcagtccaacgcccccatccaggacgaggagcgcgacatccccgagcggagctggaactccggcaacgagtggatcacggacttcgcggggaagaccgtctggttcgtgcccagcatcaaggccggcaacgacatcgccaactgcctccgcaagaacgggaagaaggtgatccagctgtcccggaagaccttcgacaccgagtaccagaagacgaagctgaacgactgggacttcgtcgtgaccaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcacgggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacacggaccggaagtggtgcttcgacgggcagcgcaacaaccagatcctggaggagaacatggacgtggagatctggaccaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacgcgcaacgccctggacaacctggtgatgctccacaccagcgagcacggcgggcgggcgtaccgccacgccgtcgaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagacgaccaagcgcgacctgggcatgtccaaggagccgggggtcgtgagctccaccagctacctggacgtggacctccaccccgcctccgcctggaccctgtacgcggtcgccacgaccgtgatcacccccatgctgcggcacaccatcgagaacagcacggccaacgtgtccctcgccgccatcgcgaaccaggccgtcgtgctgatgggcctggacaaggggtggcccatcagcaagatggacctcggcgtgccgctgctggccctcgggtgctactcccaggtcaaccccctgaccctgaccgccgccgtgctcctgctgatcacccactacgcgatcatcggccccggcctccaggccaaggccacgcgcgaggcccagaagcggaccgccgcggggatcatgaagaaccccaccgtggacggcatcatgaccatcgacctggacccggtcatctacgacagcaagttcgagaagcagctgggccaggtgatgctcctggtgctgtgcgccgtccagctcctgctgatgcgcacgtcctgggccctctgcgaggccctgaccctggcgaccggccccatcaccacgctctgggagggcagccccgggaagttctggaacaccaccatcgccgtgtccatggccaacatcttccggggcagctacctggccggggccggcctggcgttctccatcatgaagtccgtggggaccggcaagcgcggcaccgggagccagggcgagacgctcggggagaagtggaagaagaagctgaaccagctgtcccggaaggagttcgacctctacaagaagtccggcatcaccgaggtcgaccgcaccgaggccaaggaggggctgaagcggggcgagatcacccaccacgccgtgtcccgcggcagcgccaagctgcagtggttcgtggagcggaacatggtcatccccgaggggcgcgtgatcgacctcggctgcgggcggggcgggtggtcctactactgcgccggcctgaagaaggtgacggaggtccgcggctacaccaagggcgggccggggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccacggtggaggagtcccgcaccatccgggtgctgaagatggtcgagccctggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcacggggaacatcgtggcgtccgtgaacatggtcagccgcctcctgctgaaccggttcaccatgacccaccgccggcccaccatcgagaaggacgtggacctcggcgccggcacgcgccacgtgaacgccgagccggagacccccaacatggacgtcatcggggagcggatcaagcgcatcaaggaggagcacaactccacctggcactacgacgacgagaacccctacaagacctgggcctaccacggcagctacgaggtgaaggccacggggtccgcgagcagcatgatcaacggcgtggtcaagctgctgaccaagccgtgggacgtggtccccatggtgacccagatggccatgaccgacacgacccccttcgggcagcagcgggtgttcaaggagaaggtcgacacccgcacgccccggtccatgccgggcacgcgccgggtgatgggcatcaccgccgagtggctctggcgcaccctggggcggaacaagaagccccgcctgtgcacccgcgaggagttcacgaagaaggtgcggaccaacgccgcgatgggcgccgtcttcaccgaggagaaccagtgggacagcgccaagaccgccgtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacacggcggggtgggacacccggatcaccgaggacgacctgcacaacgaggagaagatcacccagcagatggaccccgagcaccgccagctcgccaacgccatcttcaagctgacctaccagaacaaggtggtcaaggtgcagcggccgacgcccaccggcaccgtgatggacatcatctcccgcaaggaccagcggggcagcgggcaggtcggcacctacgggctgaacacgttcaccaacatggaggcccagctcatccgccagatggagggcgagggggtgctgtccaaggccgacctggagaacccccacctccccgagaagaagatcacccagtggctggagaccaagggcgtggagcggctgaagcgcatggcgatcagcggcgacgactgcgtcgtgaagccgatcgacgaccggttcgccaacgccctcctggccctgaacgacatggggaaggtgcgcaaggacatcccccagtggcagccctccaagggctggcacgactggcagcaggtccccttctgcagccaccacttccacgagctcatcatgaaggacgggcggaagctggtggtgccgtgccgcccccaggacgagctgatcggccgggcccgcatctcccagggggcgggctggagcctccgcgagacggcctgcctgggcaaggcctacgcccagatgtggtccctgatgtacttccaccggcgcgacctccggctggcgagcaacgccatctgctccgccgtccccgtgcactgggtgcccaccagccgcaccacctggagcatccacgcccaccaccagtggatgacgaccgaggacatgctgaccgtctggaaccgggtgtggatcgaggacaacccgtggatggaggacaagacccccgtgacgacctgggaggacgtcccctacctcgggaagcgcgaggaccagtggtgcggctccctgatcgggctgaccagccgggccacctgggcgcagaacatccccacggccatccagcaggtccgctccctcatcggcaacgaggagttcctggactacatgccgagcatgaagcggttccgcaaggaggaggagtccgagggggccatctggtga

SEQ ID NO: 10102 - RNA, 9873 nt, synthetic construct
  misc_feature 1..9873: note = derived and/or modified CDS sequence (opt1) from DENV-3__KJ189290__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcggaacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgtccaaggagccgggggtcgtgagccccacctcctacctggacgtggacctccaccccgccagcgcctggaccctgtacgcggtcgccaccacggtgatcacccccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagcgctccggcatcacggaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcacgatgacccaccggcgcccgaccatcgagaaggacgtggacctcggcgccggcacccggcacgtgaacgccgagcccgagacgcccaacatggacgtcatcggggagcgcatcaagcggatcaaggaggagcacaacagcacctggcactacgacgaggagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgcgtgttcaaggagaaggtcgacacccggaccccgcgcagcatgcccggcacccggcgcgtgatgggcatcacggccgagtggctctggcggaccctggggcgcaacaagaagccccgcctgtgcacccgggaggagttcaccaagaaggtgcgcacgaacgccgcgatgggcgccgtcttcaccgaggagaaccagtgggactccgccaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccggcacggtgatggacatcatcagccggaaggaccagcgcggctccgggcaggtcggcacctacgggctgaacaccttcaccaacatggaggcccagctcatccggcagatggagggcgagggggtgctgagcaaggcggacctggagaacccccacctcccggagaagaagatcacgcagtggctggagaccaagggcgtggagcgcctgaagcggatggccatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcgcgcatcagccagggggccggctggtccctccgggagaccgcctgcctgggcaaggcctacgcgcagatgtggagcctgatgtacttccaccgccgggacctccgcctggcctccaacgccatctgcagcgccgtccccgtgcactgggtgccgacctcccggacgacctggagcatccacgcccaccaccagtggatgaccaccgaggacatgctgacggtctggaaccgcgtgtggatcgaggacaacccctggatggaggacaagacccccgtgaccacctgggaggacgtcccctacctcgggaagcgggaggaccagtggtgcggcagcctgatcgggctgacgtcccgcgcgacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10103 - RNA, 9873 nt, synthetic construct
  misc_feature 1..9873: note = derived and/or modified CDS sequence (opt1) from DENV-3__KJ189291__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcggaacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgtccaaggagccgggggtcgtgagccccacctcctacctggacgtggacctccaccccgccagcgcctggaccctgtacgcggtcgccaccacggtgatcacccccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagcgctccggcatcacggaggtcgaccggaccgaggccaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcaccgggaacatcgtggcgagcgtgaacatggtctcccggctcctgctgaaccgcttcacgatgacccaccggcgcccgaccatcgagaaggacgtggacctcggcgccggcacccggcacgtgaacgccgagcccgagacgcccaacatggacgtcatcggggagcgcatcaagcggatcaaggaggagcacaacagcacctggcactacgacgaggagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgcgtgttcaaggagaaggtcgacacccggaccccgcgcagcatgcccggcacccggcgcgtgatgggcatcacggccgagtggctctggcggaccctggggcgcaacaagaagccccgcctgtgcacccgggaggagttcaccaagaaggtgcgcacgaacgccgcgatgggcgccgtcttcaccgaggagaaccagtgggactccgccaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccggcacggtgatggacatcatcagccggaaggaccagcgcggctccgggcaggtcggcacctacgggctgaacaccttcaccaacatggaggcccagctcatccggcagatggagggcgagggggtgctgagcaaggcggacctggagaacccccacctcccggagaagaagatcacgcagtggctggagaccaagggcgtggagcgcctgaagcggatggccatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcgcgcatcagccagggggccggctggtccctccgggagaccgcctgcctgggcaaggcctacgcgcagatgtggaccctgatgtacttccaccgccgggacctccgcctggccagcaacgccatctgctccgccgtccccgtgcactgggtgccgacgagccggaccacctggtccatccacgcccaccaccagtggatgaccacggaggacatgctgaccgtctggaaccgcgtgtggatcgaggacaacccctggatggaggacaagacccccgtgaccacgtgggaggacgtcccctacctcgggaagcgggaggaccagtggtgcggcagcctgatcgggctgaccagccgcgcgacctgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10104 - RNA, 9873 nt, synthetic construct
  misc_feature 1..9873: note = derived and/or modified CDS sequence (opt1) from DENV-3__KJ189292__SS-prME
  source 1..9873: mol_type = other RNA
accagcctctgcctcatgatgatcctgcccgccgccctggccttccacctcaccagccgcgacggggagccgcggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcaccgaggccgagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacccgcacccagacctggatgagcgccgagggcgcctggcggcaggtcgagaaggtggagacctgggcgctgcgccacccggggttcaccatcctcgccctgttcctggcccactacatcggcacctccctcacccagaaggtggtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccaccctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgcgaagaagcaggaggtggtcgtgctggggtcccaggagggcgccatgcacacggccctcaccggggccaccgagatccagaacagcggcgggacctccatcttcgccggccacctgaagtgccggctgaagatggacaagctcgagctgaagggcatgagctacgcgatgtgcacgaacaccttcgtgctgaagaaggaggtctccgagacccagcacgggaccatcctcatcaaggtggagtacaagggcgaggacgccccgtgcaagatccccttcagcacggaggacgggcacggcaaggcccacaacggccgcctgatcaccgccaaccccgtggtcaccaagaaggaggagcccgtgaacatcgaggcggagccgcccttcggggagagcaacatcatgatcggcatcggggacaacgccctgaagatcaactggtacaagaagggctccagcatcgggaagatgttcgaggccaccgcccggggcgcccgccggatggcgatcctgggcgacacggcctgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgcggtggtccaggccgacatggggtgcatcatcaactggaagggcaaggagctgaagtgcggcagcgggatcttcgtgaccaacgaggtgcacacctggaccgagcagtacaagttccaggccgactcccccaagcgcctcgccacggccatcgcgggcgcctgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgcggagacgcagaacagctccttcatcatcgacggccccaacacccccgagtgccccagcgcctcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggcggtgcacgccgacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgcgggcagcgggaaggtggacaacttcaccatgggcgtgctgtgcctcgccatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgcgctgatcgccaccttcaagatccagcccttcctggccctcgggttcttcctgcggaagctgaccagccgcgagaacctcctgctgggcgtgggcctcgccatggcgacgaccctgcagctgcccgaggacatcgagcagatggccaacgggatcgccctcggcctgatggccctgaagctcatcacccagttcgagacctaccagctgtggacggccctgatcagcctgacctgctccaacaccatcttcaccctgacggtggcgtggcggaccgccaccctgatcctcgccggggtcagcctgctgccggtgtgccagtccagctccatgcgcaagaccgactggctccccatggccgtggccgcgatgggcgtgccgcccctcccgctgttcatcttcagcctcaaggacacgctgaagcgccggtcctggcccctgaacgagggggtgatggccgtcggcctcgtgagcatcctggcctccagcctgctccgcaacgacgtgcccatggccggccccctggtcgccgggggcctgctcatcgcgtgctacgtgatcaccgggacctccgccgacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgcgctcctgatcgtctccggcatcttcccgtacagcatccccgccaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcgtccgtgaagaaggacctgatcagctacggcgggggctggcgcctctccacccagtggcagaagggggaggaggtccaggtgatcgccgtggagcccggcaagaaccccaagaacttccagaccatccccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgcggagccggacggcagcacccccgagctggaggaggagatgttcaagaagcgcaacctcacgatcatggacctgcaccccgggtccggcaagacccggaagtacctgcccgccatcgtgcgcgaggccatcaagcggcgcctccggaccctgatcctggccccgacccgcgtcgtggccgcggagatggaggaggccctcaaggggctgcccatccggtaccagacgaccgccaccaagagcgagcacaccggccgcgagatcgtggacctgatgtgccacgccacgttcaccatgcggctcctgtcccccgtccgcgtgcccaactacaacctgatcatcatggacgaggcccacttcaccgacccggcgagcatcgccgcccgggggtacatctccacccgcgtgggcatgggcgaggccgcggccatcttcatgacggccacgccgcccgggaccgccgacgccttcccccagagcaacgcgccgatccaggacgaggagcgcgacatccccgagcggtcctggaacagcggcaacgagtggatcaccgacttcgccgggaagacggtctggttcgtgccctccatcaaggccggcaacgacatcgccaactgcctccgcaagaacgggaagaaggtgatccagctgagccggaagaccttcgacaccgagtaccagaagaccaagctgaacgactgggacttcgtcgtgacgaccgacatctccgagatgggcgccaacttcaaggcggaccgcgtgatcgacccccggcgctgcctcaagccggtcatcctgaccgacggccccgagcgggtgatcctggccgggcccatgcccgtgaccgtcgccagcgccgcccagcgccggggccgcgtggggcggaacccgcagaaggagaacgaccagtacatcttcaccggccagcccctcaacaacgacgaggaccacgcgcactggacggaggccaagatgctgctggacaacatcaacacccccgaggggatcatccccgccctcttcgagccggagcgcgagaagtccgccgcgatcgacggcgagtaccggctgaagggcgagagccgcaagaccttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctacagcgaccccctggccctcaaggagttcaaggacttcgcggccggccggaagtccatcgccctggacctggtcaccgagatcgggcgcgtgccgagccacctcgcccaccggacccgcaacgccctggacaacctggtcatgctccacacgagcgagcacggcgggcgggcgtaccgccacgccgtggaggagctgcccgagaccatggagaccctgctcctgctgggcctcatgatcctgctgaccgggggcgccatgctgttcctgatctccggcaaggggatcggcaagacgagcatcgggctgatctgcgtgatcgcctccagcggcatgctctggatggccgagatccccctgcagtggatcgcgtccgccatcgtcctggagttcttcatgatggtgctcctgatcccggagcccgagaagcagcggacgccccaggacaaccagctggcctacgtggtcatcgggatcctcaccctggccgccatcatcgcggccaacgagatgggcctgctcgagaccacgaagcgcgacctgggcatgagcaaggagcccggggtggtgtccccgaccagctacctggacgtcgacctccaccccgcctccgcctggaccctgtacgcggtggccaccacggtgatcacccccatgctgcggcacaccatcgagaacagcaccgccaacgtctccctcgccgccatcgcgaaccaggccgtggtgctgatgggcctggacaaggggtggcccatcagcaagatggacctcggcgtcccgctgctggccctcgggtgctactcccaggtgaaccccctgacgctgaccgccgccgtgctcctgctgatcacccactacgcgatcatcggccccggcctccaggccaaggccacccgcgaggcccagaagcggacggccgcggggatcatgaagaaccccaccgtcgacggcatcatgaccatcgacctggacccggtgatctacgacagcaagttcgagaagcagctgggccaggtgatgctcctggtcctgtgcgccgtgcagctcctgctgatgcgcacctcctgggccctctgcgaggccctgacgctggcgaccggccccatcaccaccctctgggagggcagccccgggaagttctggaacacgaccatcgccgtgtccatggccaacatcttccggggcagctacctggccggggccggcctggcgttctccatcatgaagtccgtcgggaccggcaagcgcggcaccgggagccagggcgagaccctcggggagaagtggaagaagaagctgaaccagctgtcccggaaggagttcgacctctacaagaagtccggcatcacggaggtggaccgcaccgaggccaaggaggggctgaagcggggcgagatcacccaccacgccgtgtcccgcggcagcgccaagctgcagtggttcgtcgagcggaacatggtgatccccgaggggcgcgtgatcgacctcggctgcgggcggggcgggtggtcctactactgcgccggcctgaagaaggtcaccgaggtgcgcggctacacgaagggcgggccggggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccgcacgatccgggtcctgaagatggtggagccctggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcaccgggaacatcgtggcgtccgtcaacatggtgagccgcctcctgctgaaccggttcacgatgacccaccgccggcccaccatcgagaaggacgtggacctcggcgccggcacccgccacgtcaacgccgagccggagacgcccaacatggacgtgatcggggagcggatcaagcgcatcaaggaggagcacaactccacctggcactacgacgacgagaacccctacaagacctgggcctaccacggcagctacgaggtgaaggccaccgggtccgcgagcagcatgatcaacggcgtcgtgaagctgctgacgaagccgtgggacgtggtccccatggtgacccagatggccatgaccgacaccacgcccttcgggcagcagcgggtcttcaaggagaaggtggacacccgcacgccccggtccatgccgggcacccgccgggtgatgggcatcacggccgagtggctctggcgcaccctggggcggaacaagaagccccgcctgtgcacccgcgaggagttcaccaagaaggtccggacgaacgccgcgatgggcgccgtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacccggatcacggaggacgacctgcacaacgaggagaagatcacccagcagatggaccccgagcaccgccagctcgccaacgccatcttcaagctgacctaccagaacaaggtcgtgaaggtgcagcggccgacccccaccggcacggtcatggacatcatctcccgcaaggaccagcggggcagcggccaggtgggcacctacgggctgaacaccttcaccaacatggaggtgcagctcatccgccagatggagggcgagggggtcctgtccaaggccgacctggagaacccccacctccccgagaagaagatcacgcagtggctggagaccaagggcgtggagcggctgaagcgcatggcgatcagcggcgacgactgcgtggtcaagccgatcgacgaccggttcgccaacgccctcctggccctgaacgacatggggaagatccgcaaggacatcccccagtggcagccctccaagggctggcacgactggcagcaggtccccttctgcagccaccacttccacgagctcatcatgaaggacgggcggaagctggtggtcccgtgccgcccccaggacgagctgatcggccgggcccgcatctcccagggggcgggctggagcctccgcgagaccgcctgcctgggcaaggcctacgcccagatgtggtccctgatgtacttccaccggcgcgacctccggctggcgagcaacgccatctgctccgccgtgcccgtgcactgggtccccaccagccgcacgacctggagcatccacgcccaccaccagtggatgaccaccgaggacatgctgacggtgtggaaccgggtgtggatcgaggacaacccgtggatggaggacaagacccccgtcaccacctgggaggacgtgccctacctcgggaagcgcgaggaccagtggtgcggctccctgatcgggctgacgagccgggccacctgggcgcagaacatccccaccgccatccagcaggtccgctccctcatcggcaacgaggagttcctggactacatgccgagcatgaagcggttccgcaaggaggaggagtccgagggggccatctggtga

SEQ ID NO: 10105 - RNA, 9873 nt, synthetic construct
  misc_feature 1..9873: note = derived and/or modified CDS sequence (opt1) from DENV-3__KJ189293__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgtccaaggagccgggggtcgtgagccccacctcctacctggacgtggacctccaccccgccagcgcctggaccctgtacgcggtcgccaccacggtgatcacccccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggccaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggcgagcgtgaacatggtctcccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggcggacctggagaacccccacctcccggagaagaagatcacgcagtggctggagaccaagggcgtggagcggctgaagcgcatggccatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggcagcctgatcgggctgacgtcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10106 - RNA, 9873 nt, synthetic construct
  misc_feature 1..9873: note = derived and/or modified CDS sequence (opt1) from DENV-3__KJ189294__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcatcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtgtgggaggtcgaggactacgggttcggcgtgttcaccaccaacatctggctccgcctgcgggaggtgtacacccagctgtgcgaccaccgcctcatgagcgccgccgtcaaggacgagcgggccgtgcacgcggacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtgatcaccgagaactgcgggacgcggggccccagcctccgcaccaccaccgtctccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtcgacaacttcaccatgggcgtgctgtgcctcgcgatcctgttcgaggaggtgatgcgcgggaagttcggcaagaagcacatgatcgccggggtcttcttcaccttcgtgctgctcctgtccggccagatcacctggcgggacatggcccacacgctgatcatgatcggcagcaacgcctccgaccgcatggggatgggcgtgacctacctcgccctgatcgcgaccttcaagatccagcccttcctggccctcgggttcttcctgcggaagctgaccagccgcgagaacctcctgctgggcgtcggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtgagcctgctgccggtctgccagtccagctccatgcgcaagaccgactggctccccatggccgtggccgccatgggcgtgccgcccctcccgctgttcatcttcagcctcaaggacacgctgaagcgccggtcctggcccctgaacgagggggtgatggcggtgggcctcgtcagcatcctggcctccagcctgctccgcaacgacgtgcccatggccggccccctggtggccgggggcctgctcatcgcctgctacgtcatcaccgggacctccgcggacctgaccgtggagaaggccgccgacatcacgtgggaggaggaggccgagcagaccggcgtgagccacaacctgatgatcaccgtcgacgacgacgggaccatgcggatcaaggacgacgagaccgagaacatcctcacggtgctgctgaagaccgccctcctgatcgtgtccggcatcttcccgtacagcatccccgcgaccctgctcgtctggcacacctggcagaagcagacgcagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacgcgcggcgccgtcctcacctacaacgggaagcggctggagcccaactgggcctccgtgaagaaggacctgatcagctacggcgggggctggcgcctctccacccagtggcagaagggggaggaggtgcaggtcatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtggtcgggctgtacggcaacggggtggtgaccaagaacggcgggtacgtctccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtggtcgccgccgagatggaggaggcgctcaaggggctgcccatccggtaccagacgaccgccaccaagtccgagcacaccggccgcgagatcgtggacctgatgtgccacgccacgttcaccatgcggctcctgagccccgtgcgcgtcccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtgtggttcgtccccagcatcaaggccggcaacgacatcgccaactgcctccgcaagaacgggaagaaggtgatccagctgtcccggaagaccttcgacaccgagtaccagaagaccaagctgaacgactgggacttcgtggtcacgaccgacatcagcgagatgggcgccaacttcaaggccgaccgcgtgatcgacccgcggcgctgcctcaagcccgtgatcctgaccgacggccccgagcgggtcatcctggcggggcccatgccggtgaccgccgcctccgccgcccagcgccggggccgcgtggggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtcgagctgatgcggcgcggggacctccccgtgtggctggcccacaaggtggccagcgagggcatcaagtacaccgaccggaagtggtgcttcgacgggcagcgcaacaaccagatcctggaggagaacatggacgtcgagatctggacgaaggagggcgagaagaagaagctccggccccgctggctggacgcccgcacctactccgacccgctggccctcaaggagttcaaggacttcgcggccggccgcaagagcatcgccctggacctggtgaccgagatcgggcgcgtcccctcccacctcgcccaccggacccgcaacgccctggacaacctggtgatgctccacacgagcgagcacggcgggcgggcgtaccgccacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgccagctccggcatgctctggatggccgagatcccgctgcagtggatcgcgagcgccatcgtgctggagttcttcatgatggtgctcctgatccccgagcccgagaagcagcggacgccccaggacaaccagctggcctacgtcgtgatcgggatcctcaccctggccgccatcatcgcggccaacgagatgggcctgctcgagaccacgaagcgcgacctgggcatgtccaaggagccgggggtggtcagccccacctcctacctggacgtggacctccaccccgccagcgcctggaccctgtacgcggtggccaccacggtcatcacccccatgctgcggcacaccatcgagaactccaccgccaacgtgagcctcgccgccatcgcgaaccaggccgtggtcctgatgggcctggacaaggggtggccgatctccaagatggacctcggcgtgcccctgctggccctcgggtgctacagccaggtgaaccccctgacgctgaccgccgccgtcctcctgctgatcacccactacgcgatcatcggccccggcctccaggccaaggccacccgcgaggcccagaagcggacggccgcggggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcgcaccagctgggccctctgcgaggccctgacgctggcgaccggccccatcaccaccctctgggagggctcccccgggaagttctggaacacgaccatcgccgtcagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccgcacgatccgggtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgcgagcgtgaacatggtgtcccgcctcctgctgaaccggttcacgatgacccaccgccggccgaccatcgagaaggacgtcgacctcggcgccggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcgtccagcatgatcaacggcgtggtgaagctgctgacgaagccctgggacgtcgtgcccatggtcacccagatggccatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgcgaggagttcaccaagaaggtgcggacgaacgccgcgatgggcgccgtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggcggacctggagaacccccacctcccggagaagaagatcacgcagtggctggagaccaagggcgtggagcggctgaagcgcatggccatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggaggacgtgccctacctcgggaagcgcgaggaccagtggtgcggcagcctgatcgggctgacgtcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10107 - RNA, 9873 nt, synthetic construct
  misc_feature 1..9873: note = derived and/or modified CDS sequence (opt1) from DENV-3__KJ189295__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgtccaaggagccgggggtcgtgagccccacctcctacctggacgtggacctccaccccgccagcgcctggaccctgtacgcggtcgccaccacggtgatcacccccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggccaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggcgagcgtgaacatggtctcccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgctgaaggcggacctcgagaacccccacctccccgagaagaagatcacgcagtggctggagaccaagggcgtggagcggctcaagcgcatggccatcagcggcgacgactgcgtcgtgaagcccatcgacgaccggttcgccaacgccctgctggccctcaacgacatggggaaggtgcgcaaggacatcccccagtggcagccctccaagggctggcacgactggcagcaggtcccgttctgcagccaccacttccacgagctgatcatgaaggacgggcggaagctggtggtgccctgccgcccccaggacgagctcatcggccgggcgcgcatctcccagggggccggctggagcctgcgcgagaccgcctgcctgggcaaggcctacgcgcagatgtggtccctcatgtacttccaccggcgcgacctgcggctggccagcaacgccatctgctccgccgtccccgtgcactgggtgccgaccagccgcacgacctggtccatccacgcccaccaccagtggatgaccaccgaggacatgctcacggtctggaaccgggtgtggatcgaggacaacccctggatggaggaccgcacccccgtgaccacctgggaggacgtcccctacctggggaagcgggaggaccagtggtgcggcagcctgatcgggctcacgagccgcgcgacctgggcccagaacatcccgaccgccatccagcaggtccggtccctgatcggcaacgaggagttcctggactacatgcccagcatgaagcgcttccggaaggaggaggagtccgagggggccatctggtga

SEQ ID NO: 10108 - RNA, 9873 nt, synthetic construct
  misc_feature 1..9873: note = derived and/or modified CDS sequence (opt1) from DENV-3__KJ189297__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgtccaaggagccgggggtcgtgagccccacctcctacctggacgtggacctccaccccgccagcgcctggaccctgtacgcggtcgccaccacggtgatcacccccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggccaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggcgagcgtgaacatggtctcccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctcccagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggcggacctggagaacccccacctcccggagaagaagatcacgcagtggctggagaccaagggcgtggagcggctgaagcgcatggccatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggcagcctgatcgggctgacgtcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10109 - RNA, 9873 nt, synthetic construct
  misc_feature 1..9873: note = derived and/or modified CDS sequence (opt1) from DENV-3__KJ189298__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgaccctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgcgccgtgcaagatccccttcagcacggaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacacggcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcggacatggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgccggcgcgtgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctccgcctgcgggaggtctacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaaccaccgcccgggctaccacacccagacggccgggccctggcacctcggcaagctggagctggacttcaactactgcgagggcaccaccgtggtcatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtctccgccggcagcgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgtccggccagatcacctggcggaacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgcgaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcctccgtgaagaaggacctgatcagctacggcgggggctggcgcctctccacccagtggcagaagggggaggaggtccaggtgatcgcggtggagcccggcaagaaccccaagaacttccagaccatgcccggcacgttccagaccaccaccggggagatcggcgccatcgccctggacttcaagcccgggacgagcggcagccccatcatcaaccgggagggcaaggtcgtggggctgtacggcaacggggtggtcaccaagaacggcgggtacgtgtccggcatcgcccagaccaacgccgagccggacggccccacccccgagctggaggaggagatgttcaagaagcgcaacctcacgatcatggacctgcaccccgggagcggcaagacccggaagtacctgccggcgatcgtgcgcgaggccatcaagcggcgcctccggaccctgatcctggcccccacccgcgtcgtggccgccgagatggaggaggcgctcaaggggctgcccatccggtaccagacgaccgccaccaagtccgagcacaccggccgcgagatcgtggacctgatgtgccacgccacgttcaccatgcggctcctgagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgacgccttcccgcagtccaacgcccccatccaggacgaggagcgcgacatccccgagcggagctggaactccggcaacgagtggatcaccgacttcgcggggaagacggtctggttcgtgcccagcatcaaggccggcaacgacatcgccaactgcctccgcaagaacgggaagaaggtgatccagctgtcccggaagaccttcgacaccgagtaccagaagaccaagctgaacgactgggacttcgtcgtgacgaccgacatcagcgagatgggcgccaacttcaaggccgaccgcgtgatcgacccgcggcgctgcctcaagcccgtcatcctgaccgacggccccgagcgggtgatcctggcggggcccatgccggtgaccgccgcctccgccgcccagcgccggggccgcgtcgggcggaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgcgagaagtccgccgcgatcgacggcgagtaccggctgaagggcgagtcccgcaagaccttcgtggagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctactccgacccgctggccctcaaggagttcaaggacttcgcggccggccgcaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcaccctggccgccatcatcgcggccaacgagatgggcctgctcgagaccacgaagcgcgacctgggcatgtccaaggagccgggggtcgtgagccccacctcctacctggacgtggacctccaccccgccagcgcctggaccctgtacgcggtcgccaccacggtgatcacccccatgctgcggcacaccatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgcgatcatcggccccggcctccaggccaaggccacccgcgaggcccagaagcggacggccgcggggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggccaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccgcacgatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggcgagcgtgaacatggtctcccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaacagcacctggcactacgacgaggagaacccgtacaagacctgggcctaccacggctcctacgaggtgaaggccaccgggagcgcgtccagcatgatcaacggcgtggtcaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgcgaggagttcaccaagaaggtgcggacgaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggcggacctggagaacccccacctcccggagaagaagatcacgcagtggctggagaccaagggcgtggagcggctgaagcgcatggccatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggaggacgtcccctacctcgggaagcgcgaggaccagtggtgcggcagcctgatcgggctgacgtcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10110 - RNA, 9873 nt, synthetic construct
  misc_feature 1..9873: note = derived and/or modified CDS sequence (opt1) from DENV-3__KJ189301__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggaccaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacgtggatgagcgccgagggcgcctggcgccaggtggagaaggtggagacctgggccctgcgccacccggggttcaccatcctcgcgctgttcctggcccactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgaccctgcccgagtacggcacgctggggctcgagtgctccccgcgcaccggcctggacttcaacgagatgatcctgctcaccatgaagaacaaggcctggatggtgcaccggcagtggttcttcgacctgcccctgccctggaccagcggcgccacgaccgagacccccacctggaaccgcaaggagctcctggtgacgttcaagaacgcccacgccaagaagcaggaggtcgtggtgctggggtcccaggagggcgcgatgcacaccgccctcaccggggccaccgagatccagaacagcggcgggacgtccatcttcgccggccacctgaagtgccggctgaagatggacaagctcgagctgaagggcatgagctacgccatgtgcaccaacaccttcgtcctgaagaaggaggtgtccgagacccagcacgggacgatcctcatcaaggtggagtacaagggcgaggacgcgccgtgcaagatccccttcagcaccgaggacgggcacggcaaggcccacaacggccgcctgatcaccgccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccacggcccggggcgcccgccggatggccatcctgggcgacaccgcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacctggacggagcagtacaagttccaggccgactcccccaagcgcctcgccaccgccatcgccggcgcgtgggagaacggggtctgcggcatccgcagcaccacccggatggagaacctgctgtggaagcagatcgccaacgagctcaactacatcctgtgggagaacaacgtgaagctgacggtggtcgtgggggacatcatcggcgtgctcgagcgcggcaagcggaccctgacgccccagccgatggagctgaagtactcctggaagacctgggggaaggccaagatcgtcacggccgagacccagaacagctccttcatcatcgacggccccaacacccccgagtgccccagcgcgtcccgcgcctggaacgtgtgggaggtggaggactacgggttcggcgtcttcaccaccaacatctggctccggctgcgcgaggcctacacgcagctgtgcgaccaccggctcatgagcgccgccgtgaaggacgagcgcgcggtgcacgccgacatgggctactggatcgagagccagaagaacgggtcctggaagctggagaaggccagcctgatcgaggtcaagacctgcacctggccgaagtcccacaccctctggagcaacggcgtgctggagtccgacatgatcatccccaagagcctggccgggcccatctcccagcacaaccaccggccgggctaccacacgcagaccgccgggccctggcacctcggcaagctggagctggacttcaactactgcgagggcaccaccgtggtcatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgcgggcagcgggaaggtggacaacttcaccatgggcgtgctgtgcctcgccatcctgttcgaggaggtcatgcgggggaagttcggcaagaagcacatgatcgccggggtgttcttcaccttcgtgctgctcctgtccggccagatcacgtggcgcgacatggcccacaccctgatcatgatcggcagcaacgcctccgaccggatggggatgggcgtcacctacctcgcgctgatcgccaccttcaagatccagcccttcctggccctcgggttcttcctgcgcaagctgacgagccgggagaacctcctgctgggcgtgggcctcgccatggcgaccaccctgcagctgcccgaggacatcgagcagatggccaacgggatcgccctcggcctgatggccctgaagctcatcacccagttcgagacgtaccagctgtggaccgccctgatcagcctgacctgctccaacaccatcttcacgctgaccgtggcgtggcgcaccgccaccctgatcctcgccggggtcagcctgctgccggtgtgccagtccagctccatgcgcaagacggactggctccccatggccgtcgccgcgatgggcgtgccgcccctcccgctgttcatcttcagcctcaaggacaccctgaagcggcgctcctggcccctgaacgagggggtgatggccgtcggcctcgtgagcatcctggcctccagcctgctccggaacgacgtgcccatggccggccccctggtcgccgggggcctgctcatcgcgtgctacgtgatcaccgggacctccgccgacctgacggtggagaaggccgccgacatcacctgggaggaggaggccgagcagaccggcgtcagccacaacctgatgatcaccgtggacgacgacgggaccatgcgcatcaaggacgacgagacggagaacatcctcaccgtgctgctgaagaccgcgctcctgatcgtctccggcatcttcccgtacagcatccccgccaccctgctcgtgtggcacacgtggcagaagcagacccagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacacgatgtggcacgtcacccggggcgccgtgctcacctacaacgggaagcgcctggagcccaactgggcgtccgtgaagaaggacctgatcagctacggcgggggctggcggctctccacccagtggcagaagggggaggaggtccaggtgatcgccgtggagcccggcaagaaccccaagaacttccagacgatgcccggcaccttccagaccaccacgggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagaccaacgcggagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtcgtggccgcggagatggaggaggccctcaaggggctgcccatccgctaccagaccaccgccaccaagtccgagcacacgggccgggagatcgtggacctgatgtgccacgccaccttcaccatgcgcctcctgagccccgtccgggtgccgaactacaacctgatcatcatggacgaggcccacttcaccgaccccgcgtccatcgccgcccgcgggtacatcagcacgcgcgtgggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcacggacttcgccgggaagaccgtctggttcgtgcccagcatcaaggccggcaacgacatcgccaactgcctccggaagaacgggaagaaggtgatccagctgtcccgcaagaccttcgacaccgagtaccagaagacgaagctgaacgactgggacttcgtcgtgaccaccgacatcagcgagatgggcgccaacttcaaggcggaccgggtgatcgacccgcgccggtgcctcaagcccgtcatcctgaccgacggccccgagcgcgtgatcctggccgggcccatgccggtgaccgccgcctccgccgcgcagcggcgcggccgggtcgggcgcaacccccagaaggagaacgaccagtacatcttcacgggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagaccttcgtggagctgatgcgccgcggggacctccccgtgtggctggcccacaaggtcgccagcgagggcatcaagtacacggaccgcaagtggtgcttcgacgggcagcggaacaaccagatcctggaggagaacatggacgtggagatctggaccaaggagggcgagaagaagaagctccgcccccgctggctggacgcccggacctactccgacccgctggcgctcaaggagttcaaggacttcgccgccggccgcaagagcatcgccctggacctggtcaccgagatcgggcgggtgccctcccacctcgcccaccgcacgcggaacgcgctggacaacctggtgatgctccacaccagcgagcacggcgggcgcgcctaccggcacgccgtcgaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtgctggagttcttcatgatggtcctcctggtgcccgagcccgagaagcagcgcacgccccaggacaaccagctggcctacgtggtcatcgggatcctcaccctggccgcgatcatcgccgccaacgagatgggcctgctcgagacgaccaagcgggacctgggcatgtccaaggagccgggggtggtgagccccacctcctacctggacgtcgacctccaccccgccagcgcgtggaccctgtacgccgtggccacgaccgtgatcacccccatgctgcgccacaccatcgagaactccacggccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgaccgccgcggtgctcctgctgatcacccactacgccatcatcggccccggcctccaggccaaggccacgcgggaggcccagaagcgcaccgcggccgggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcggacgagctgggccctctgcgaggcgctgaccctggccaccggccccatcaccacgctctgggagggctcccccgggaagttctggaacaccaccatcgccgtgagcatggccaacatcttccgcggctcctacctggccggggcgggcctggccttcagcatcatgaagtccgtcgggaccggcaagcggggcaccgggagccagggcgagacgctcggggagaagtggaagaagaagctgaaccagctgagccgcaaggagttcgacctctacaagaagtccggcatcaccgaggtggaccggaccgaggccaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcacggaggtgcgcggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccggaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacccacgagatgtactggatctccaacggcacggggaacatcgtggccagcgtcaacatggtgtcccggctcctgctgaaccgcttcaccatgacccaccggcgcccgaccatcgagaaggacgtggacctcggcgccggcacgcggcacgtcaacgccgagcccgagacccccaacatggacgtgatcggggagcgcatcaagcggatcaaggaggagcacaacagcacctggcactacgacgacgagaacccgtacaagacctgggcctaccacggctcctacgaggtgaaggcgacggggagcgcctccagcatgatcaacggcgtcgtgaagctgctgaccaagccctgggacgtcgtgcccatggtgacccagatggccatgaccgacacgacccccttcgggcagcagcgcgtcttcaaggagaaggtggacacccggaccccgcgcagcatgcccggcacgcggcgcgtgatgggcatcaccgccgagtggctctggcggaccctggggcgcaacaagaagccccgcctgtgcacccgggaggagttcacgaagaaggtccgcaccaacgcggccatgggcgccgtgttcaccgaggagaaccagtgggactccgccaaggccgcggtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacaccgccgggtgggacacgcgcatcaccgaggacgacctgcacaacgaggagaagatcacccagcagatggacccggagcaccggcagctcgccaacgccatcttcaagctgacctaccagaacaaggtcgtgaaggtgcagcgccccacccccacgggcaccgtcatggacatcatcagccggaaggaccagcgcggctccggccaggtgggcacctacgggctgaacaccttcacgaacatggaggcgcagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgccaacgccctcctggcgctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccgcatcagccagggggccggctggtccctccgggagaccgcctgcctgggcaaggcgtacgcccagatgtggagcctgatgtacttccaccgccgggacctccgcctggcctccaacgccatctgcagcgccgtgcccgtgcactgggtcccgacgtcccggaccacctggagcatccacgcgcaccaccagtggatgaccacggaggacatgctgaccgtgtggaaccgcgtgtggatcgaggacaacccctggatggaggacaagacccccgtcaccacgtgggaggacgtgccctacctcgggaagcgggaggaccagtggtgcggcagcctgatcgggctgacctcccgcgccacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10111 - RNA, 9873 nt, synthetic construct
  misc_feature 1..9873: note = derived and/or modified CDS sequence (opt1) from DENV-3__KF955456__SS-prME
  source 1..9873: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtggagacctgggcgctgcgccacccggggttcacgatcctcgccctgttcctggcccactacatcggcacctccctcacccagaaggtggtgatcttcgtcctgctgatgctcgtgacccccagcatgacgatgcggtgcgtgggggtcggcaaccgcgacttcgtggagggcctgtccggggccacctgggtggacgtcgtgctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtcctgccggaggagcaggaccagaactacgtgtgcaagcacacgtacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcaccgtgcacacgggggaccagcaccaggtcggcaacgagacccagggggtgaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtcaccttcaagaacgcccacgcgaagaagcaggaggtggtggtcctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtgctgaagaaggaggtgtccgagacgcagcacgggaccatcctcatcaaggtcgagtacaagggcgaggacgccccgtgcaagatccccttcagcaccgaggacgggcagggcaaggcccacaacggccgcctgatcaccgccaaccccgtggtgacgaagaaggaggagcccgtcaacatcgaggcggagccgcccttcggggagagcaacatcgtgatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgcggtggtccaggccgacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgcgggcgcctgggagaacggggtgtgcggcatccgcagcacgacccggatggagaacctgctgtggaagcaggtcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgcggtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgcgggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacaccctggtgatgatcggcagcaacgcctccgaccggatggggatgggcgtcacgtacctcgcgctgatcgccaccttcaagatccagcccttcctggccctcgggttcttcctgcgcaagctgaccagccgggagaacctcctgctgggcgtgggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtcgcgtggcgcacggccaccctgatcctcgccggggtgagcctgctgccggtgtgccagtccagctccatgcggaagtccgactggctccccatgaccgtcgccgccatgggcgtgccgcccctcccgctgttcatcttctccctcaaggacaccctgaagcgccgcagctggcccctgaacgagggggtgatggcggtcggcctcgtgtccatcctggccagctccctgctccggaacgacgtgcccatggccggccccctggtcgccgggggcctgctcatcgcctgctacgtgatcacggggaccagcgcggacctgaccgtggagaaggccgccgacgtcacctgggaggaggaggccgagcagacgggcgtgtcccacaacctgatgatcaccgtggacgacgacgggaccatgcgcatcaaggacgacgagaccgagaacatcctcaccgtcctgctgaagacggccctcctgatcgtgagcggcatcttcccgtactccatccccgcgaccctgctcgtgtggcacacctggcagaagcagacccggcgcagcggcgtcctgtgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctcacgtacaacgggaagcggctggagcccaactgggccagcgtcaagaaggacctgatctcctacggcgggggctggcgcctcagcgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggctcccccatcatcaaccgggagggcaaggtggtggggctgtacggcaacggggtcgtgaccaagaacggcgggtacgtgagcggcatcgcccagacgaacgcggagccggacggccccacccccgagctggaggaggagatgttcaagaagcgcaacctcaccatcatggacctgcaccccgggtccggcaagacccggaagtacctgccggccatcgtccgcgaggccatcaagcggcgcctccggacgctgatcctggcccccacccgcgtggtggccgcggagatggaggaggccctcaaggggctgcccatccggtaccagaccaccgccaccaagagcgagcacaccggccgcgagatcgtcgacctgatgtgccacgccaccttcaccatgcggctcctgtcccccgtgcgcgtgccgaactacaacctgatcatcatggacgaggcccacttcacggaccccgcgagcatcgccgcccgggggtacatctccacccgcgtcggcatgggcgaggccgcggccatcttcatgaccgccacgccgcccgggacggccgacgccttcccgcagagcaacgcgcccatccaggacgaggagcgcgacatccccgagcggtcctggaacagcggcaacgagtggatcaccgacttcgccgggaagaccgtgtggttcgtgccctccatcaaggccggcaacgacatcgccaactgcctccgcaagaacgggaagaaggtcatccagctgagccggaagaccttcgacacggagtaccagaagaccaagctgaacgactgggacttcgtggtgaccaccgacatctccgagatgggcgccaacttcaaggcggaccgcgtcatcgacccgcggcgctgcctcaagcccgtgatcctgacggacggccccgagcgggtgatcctggccgggcccatgccggtcaccgccgccagcgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagagccgcaagacgttcgtcgagctgatgcggcgcggggacctccccgtgtggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacctacagcgacccgctggcgctcaaggagttcaaggacttcgccgccggccggaagtccatcgccctggacctggtgacggagatcgggcgcgtgcccagccacctcgcccaccggacccgcaacgcgctggacaacctggtcatgctccacaccagcgagcacggcgggaaggcctaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggcggagatcccgctgcagtggatcgcctccgccatcgtcctggagttcttcatgatggtgctcctgatccccgagcccgagaagcagcgcacgccccaggacaaccagctggcctacgtggtcatcgggatcctcacgctggccgcgatcatcgccgccaacgagatgggcctgctcgagaccaccaagcgggacctgggcatgagcaaggagccgggggtggtgtcccccaccagctacctggacgtcgacctccaccccgcctccgcgtggacgctgtacgccgtggccaccaccgtgatcacccccatgctgcgccacacgatcgagaacagcaccgccaacgtctccctcgccgcgatcgccaaccaggccgtggtgctgatgggcctggacaaggggtggccgatcagcaagatggacctcggcgtccccctgctggccctcgggtgctactcccaggtgaaccccctgaccctgaccgccgcggtgctcctgctgatcacgcactacgccatcatcggccccggcctccaggccaaggccacccgggaggcccagaagcgcaccgcggccgggatcatgaagaacccgaccgtcgacggcatcatgacgatcgacctggaccccgtgatctacgacagcaagttcgagaagcagctgggccaggtgatgctcctggtcctgtgcgccatccagctcctgctgatgcggacctcctgggccctctgcgaggcgctgaccctggccaccggccccatcacgaccctctgggagggcagccccgggaagttctggaacaccaccatcgccgtgtccatggccaacatcttccgcggcagctacctggccggggcgggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtcgaccggaccgaggccaaggaggggctgaagcgcggcgagatcacgcaccacgccgtgtcccggggcagcgccaagctgcagtggttcgtggagcgcaacatggtcatcccggaggggcgggtgatcgacctcggctgcgggcgcggcgggtggtcctactactgcgcgggcctgaagaaggtgaccgaggtccggggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccaccgtgatcgagcacctggagcggctccagcgcaagtacggcgggatgctggtccggaaccccctgagccgcaactccacgcacgagatgtactggatcagcaacggcaccgggaacatcgtggcctccgtgaacatggtcagccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaactccacctggcactacgacgacgagaacccgtacaagacgtgggcctaccacggcagctacgaggtgaaggcgaccgggtccgccagcagcatgatcaacggcgtcgtgaagctgctgaccaagccctgggacgtggtccccatggtgacccagatggccatgacggacaccacccccttcgggcagcagcgcgtgttcaaggagaaggtcgacacccggacgccgcgctccatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggacagcgccaaggccgcggtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatctcccggaaggaccagcgcggcagcgggcaggtcggcacctacgggctgaacacgttcaccaacatggaggcgcagctcatccggcagatggagggcgagggggtgctgaccaaggccgacctggagaacccccacctctccgagaagaagatcacccagtggctggagacgaagggcgtggagcgcctgaagcggatggccatcagcggcgacgactgcgtcgtgaagccgatcgacgaccgcttcgccaacgccctcctggcgctgaacgacatggggaaggtgcggaaggacatcccccagtggcagccctccaagggctggcacgactggcagcaggtccccttctgcagccaccacttccacgagctcatcatgaaggacgggcgcaagctggtggtgccgtgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtccccgtgcactgggtgcccaccagccggaccacgtggagcatccacgcgcaccaccagtggatgaccaccgaggacatgctgaccgtctggaaccgcgtgtggatcgaggacaacccgtggatggaggacaagacgcccgtgaccacctgggagaacgtcccctacctcgggaagcgggaggaccagtggtgcggctccctgatcgggctgaccagccgcgccacgtgggcccagaacatccccaccgccatccagcaggtccggtccctcatcggcaacgaggagttcctggactacatgccgagcatgaagcgcttccggaaggaggaggagtccgagggggccatctggtga

SEQ ID NO: 10112 - RNA, 9873 nt, synthetic construct
  misc_feature 1..9873: note = derived and/or modified CDS sequence (opt1) from DENV-3__KF955465__SS-prME
  source 1..9873: mol_type = other RNA
accagcctgtgcatcatgatgatcctccccgcggcgctggcgttccacctgaccagccgggacggggagccgcggatgatcgtggggaagaacgagcggggcaagagcctcctgttcaagacggcctccgggatcaacatgtgcaccctgatcgccatggacctcggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctggcgccccacgtgggcatggggctcgacacccgcacccagacctggatgagcgccgagggcgcctggcgccaggtggagaaggtggagacgtgggccctgcgccacccggggttcaccatcctggccctcttcctggcccactacatcggcacctccctgacccagaaggtggtgatcttcatcctcctgatgctggtgacgcccagcatgaccatgcggtgcgtgggggtgggcaaccgcgacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcggaagctctgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctgttcgggaagggctccctcgtgacctgcgccaagttccagtgcctggagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctccccgagtacggcaccctggggctggagtgctccccgcgcaccggcctcgacttcaacgagatggtgctgctgacgatgaagaacaaggcctggatggtgcaccggcagtggttcttcgacctccccctgccctggaccagcggcgccaccaccgagacgcccacctggaaccgcaaggagctgctcgtcaccttcaagaacgcccacgccaagaagcaggaggtggtggtcctggggtcccaggagggcgcgatgcacaccgccctgacgggggccaccgagatccagaacagcggcgggacctccatcttcgccggccacctcaagtgccggctgaagatggacaagctggagctcaagggcatgagctacgccatgtgcaccaacacgttcgtgctgaagaaggaggtgtccgagacccagcacgggaccatcctgatcaaggtcgagtacaagggcgaggacgtgccgtgcaagatccccttcagcaccgaggacgggcagggcaaggcgcacaacggccgcctcatcacggccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccagatcttcgggtccgcgtacacggccctgttcagcggcgtctcctgggtgatgaagatcggcatcggggtgctgctcacctggatcggcctgaacagcaagaacacctccatgagcttctcctgcatcgtcatcgggatcatcaccctgtacctcggcgccgtggtgcaggccgacatggggtgcgtcatcaactggaagggcaaggagctgaagtgcggcagcgggatcttcgtgacgaacgaggtgcacacctggaccgagcagtacaagttccaggccgactcccccaagcgcctggcgaccgccatcgccggcgcctgggagaacggggtctgcggcatccgcagcacgacccggatggagaacctcctgtggaagcagatcgccaacgagctgaactacatcctctgggagaacaacatcaagctgaccgtggtggtcggggacatcatcggcgtgctggagcagggcaagcgcaccctcacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtctgggaggtggaggactacgggttcggcgtgttcaccaccaacatctggctgaagctccgcgaggtctacacccagctgtgcgaccaccggctgatgagcgcggccgtgaaggacgagcgcgccgtgcacgccgacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggcggggcccatctcccagcacaactaccggccgggctaccacacccagaccgccgggccctggcacctgggcaagctcgagctggacttcaactactgcgagggcacgaccgtggtcatcaccgagaactgcgggacccgcggccccagcctgcggacgaccaccgtgtccgggaagctcatccacgagtggtgctgccgcagctgcaccctgcccccgctgcggtacatgggcgaggacgggtgctggtacggcatggagatccgccccatctccgagaaggaggagaacatggtcaagagcctcgtctccgccggcagcgggaaggtggacaacttcacgatgggcgtgctgtgcctggccatcctcttcgaggaggtcatgcgggggaagttcggcaagaagcacatgatcgccggggtgttcttcaccttcgtgctgctgctctccggccagatcacctggcgcgacatggcgcacaccctgatcatgatcggcagcaacgcctccgaccggatggggatgggcgtcacgtacctggccctcatcgccaccttcaagatccagcccttcctggccctggggttcttcctccgcaagctgaccagccgggagaacctgctcctgggcgtgggcctggcgatggccaccacgctccagctgcccgaggacatcgagcagatggccaacgggatcgccctgggcctcatggcgctgaagctgatcacccagttcgagacctaccagctctggaccgccctgatcagcctgacgtgctccaacaccatcttcaccctcaccgtcgcctggcgcacggccaccctgatcctggccggggtgagcctcctgccggtgtgccagtccagctccatgcggaagaccgactggctgcccatgaccgtcgcggccatgggcgtgccgcccctcccgctgttcatcttcagcctgaaggacacgctcaagcgccgctcctggcccctgaacgagggggtgatggccgtcggcctggtgagcatcctcgcctccagcctgctgcggaacgacgtgcccatggccggccccctcgtcgccggcgggctgctgatcgcctgctacgtgatcaccgggacctccgccgacctcaccgtggagaaggccgccgacgtcacgtgggaggaggaggcggagcagaccggggtgagccacaacctgatgatcaccgtggacgacgacgggaccatgcgcatcaaggacgacgagaccgagaacatcctgacggtcctcctgaagaccgccctgctcatcgtgtccggcatcttcccgtacagcatccccgccaccctgctggtgtggcacacctggcagaagcagacgcagcggtccggcgtcctctgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgccgtgctgacctacaacgggaagcgcctcgagcccaactgggcgtccgtcaagaaggacctgatcagctacggcgggggctggcggctgtccgcccagtggcagaagggggaggaggtccaggtgatcgccgtcgagcccggcaagaaccccaagaacttccagaccatgcccggcaccttccagacgaccaccggggagatcggcgccatcgcgctcgacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctgaccatcatggacctccaccccgggagcggcaagacgcgcaagtacctgccggccatcgtccgggaggccatcaagcgccggctgcgcaccctcatcctggcgcccacccgggtggtggccgccgagatggaggaggccctgaaggggctccccatccgctaccagaccacggccaccaagtccgagcacaccggccgggagatcgtcgacctgatgtgccacgcgaccttcacgatgcgcctgctcagccccgtgcgggtgccgaactacaacctgatcatcatggacgaggcccacttcaccgaccccgcctccatcgccgcccgcgggtacatcagcacccgggtcggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtgtggttcgtgcccagcatcaaggccggcaacgacatcgcgaactgcctgcggaagaacgggaagaaggtcatccagctctcccgcaagacgttcgacaccgagtaccagaagaccaagctgaacgactgggacttcgtggtgaccacggacatcagcgagatgggcgccaacttcaaggccgaccgggtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcaccggccagcccctgaacaacgacgaggaccacgcccactggaccgaggccaagatgctcctggacaacatcaacacgcccgaggggatcatcccggcgctgttcgagcccgagcgggagaagtccgccgccatcgacggcgagtaccgcctcaagggcgagtcccggaagaccttcgtcgagctgatgcgccgcggggacctgcccgtgtggctcgcccacaaggtggcgagcgagggcatcaagtacaccgaccgcaagtggtgcttcgacgggcagcggaacaaccagatcctggaggagaacatggacgtcgagatctggaccaaggagggcgagaagaagaagctgcgcccccggtggctcgacgcccgcacgtactccgacccgctggccctgaaggagttcaaggacttcgccgccggccgcaagagcatcgcgctcgacctggtgaccgagatcgggcgggtgccctcccacctggcccaccgcacccggaacgccctcgacaacctggtcatgctgcacaccagcgagcacggcgggaaggcctaccgccacgccgtggaggagctccccgagacgatggagaccctgctgctcctgggcctgatgatcctcctgaccgggggcgcgatgctgttcctcatcagcggcaaggggatcggcaagacctccatcgggctgatctgcgtgatcgccagctccggcatgctgtggatggccgagatcccgctccagtggatcgccagcgccatcgtcctggagttcttcatgatggtgctgctcatccccgagcccgagaagcagcggacgccccaggacaaccagctggcgtacgtggtcatcgggatcctgaccctcgccgccatcatcgccgccaacgagatgggcctgctggagaccaccaagcgcgacctcggcatgtccaaggagccgggggtggtgagccccacgtcctacctggacgtcgacctgcaccccgcgagcgcctggaccctctacgccgtggccaccaccgtgatcacgcccatgctgcggcacaccatcgagaactccaccgcgaacgtcagcctggccgccatcgccaaccaggccgtggtgctcatgggcctggacaaggggtggccgatctccaagatggacctgggcgtccccctcctggcgctggggtgctacagccaggtgaaccccctcaccctgacggccgccgtgctgctcctgatcacccactacgccatcatcggccccggcctgcaggccaaggcgacccgcgaggcccagaagcggaccgccgccgggatcatgaagaacccgacggtcgacggcatcatgaccatcgacctcgaccccgtgatctacgactccaagttcgagaagcagctgggccaggtgatgctgctcgtcctgtgcgccgtgcagctgctcctgatgcgcaccagctgggcgctgtgcgaggccctcaccctggccacgggccccatcaccaccctgtgggagggctcccccgggaagttctggaacaccacgatcgccgtgagcatggcgaacatcttccggggctcctacctcgccggggccggcctggccttcagcatcatgaagtccgtcgggaccggcaagcgcggcaccgggagccagggcgagaccctgggggagaagtggaagaagaagctcaaccagctgagccggaaggagttcgacctgtacaagaagtccggcatcaccgaggtggaccgcacggaggccaaggaggggctcaagcggggcgagatcacccaccacgcggtgagccgcggctccgccaagctgcagtggttcgtcgagcggaacatggtgatcccggaggggcgcgtgatcgacctgggctgcgggcggggcgggtggagctactactgcgccggcctcaagaaggtcaccgaggtgcgcggctacaccaagggcgggcccgggcacgaggagcccgtgcccatgtccacgtacggctggaacatcgtcaagctgatgagcgggaaggacgtgttctacctgccgcccgagaagtgcgacaccctcctgtgcgacatcggcgagtccagcccctcccccaccgtggaggagagccggaccatccgcgtcctgaagatggtggagccgtggctgaagaacaaccagttctgcatcaaggtgctcaacccctacatgcccacggtcatcgagcacctggagcgcctgcagcggaagcacggcgggatgctcgtgcgcaaccccctgtcccggaacagcacccacgagatgtactggatctccaacggcaccgggaacatcgtggccagcgtcaacatggtgtcccgcctgctcctgaaccggttcaccatgacgcaccgccggccgaccatcgagaaggacgtggacctgggcgccggcacccgccacgtcaacgcggagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtgaagctcctgaccaagccctgggacgtcgtgcccatggtgacgcagatggccatgaccgacaccacccccttcgggcagcagcgggtcttcaaggagaaggtggacacgcgcaccccgcggagcatgcccggcacccgccgggtgatgggcatcaccgcggagtggctgtggcgcacgctcgggcggaacaagaagccccgcctgtgcacccgggaggagttcaccaagaaggtccgcaccaacgccgccatgggcgccgtgttcacggaggagaaccagtgggactccgcgaaggccgccgtggaggacgaggacttctggatcctggtcgaccgcgagcgggagctccacaagctggggaagtgcggcagctgcgtgtacaacatgatggggaagcgcgagaagaagctgggcgagttcggcaaggccaaggggtcccgggccatctggtacatgtggctcggcgcgcgctacctggagttcgaggccctggggttcctcaacgaggaccactggttcagccgggagaactcctacagcggcgtggagggggagggcctgcacaagctgggctacatcctccgcgacatctccaagatccccgggggcgccatgtacgccgacgacaccgccgggtgggacacccggatcaccgaggacgacctgcacaacgaggagaagatcacgcagcagatggacccggagcaccgccagctggcgaacgccatcttcaagctcacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctgatccgccagatggagggcgagggggtgctcagcaaggccgacctggagaacccccacctccccgagaagaagatcacccagtggctggagacgaagggcgtcgagcggctgaagcgcatggccatctccggcgacgactgcgtggtgaagcccatcgacgaccggttcgcgaacgccctgctcgccctgaacgacatggggaaggtccgcaaggacatcccccagtggcagcccagcaagggctggcacgactggcagcaggtcccgttctgctcccaccacttccacgagctgatcatgaaggacgggcggaagctcgtggtcccctgccgcccccaggacgagctgatcggccgggcccgcatcagccagggggccggctggtccctgcgggagaccgcgtgcctcggcaaggcctacgcccagatgtggagcctgatgtacttccaccgccgcgacctgcggctcgcctccaacgcgatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctggggaagcgcgaggaccagtggtgcggcagcctcatcgggctgacctcccgggccacgtgggcccagaacatcccgaccgcgatccagcaggtccgcagcctgatcggcaacgaggagttcctcgactacatgccctccatgaagcggttccgcaaggaggaggagagcgagggggccatctggtga

SEQ ID NO: 10113 - RNA, 9873 nt, synthetic construct
  misc_feature 1..9873: note = derived and/or modified CDS sequence (opt1) from DENV-3__KF955466__SS-prME
  source 1..9873: mol_type = other RNA
accagcctgtgcctcatgatgatcctgcccgcggcgctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtctggttcgtgcccagcatcaaggccggcaacgacatcgcgaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgccgcgtccgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcccacaaggtggcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgccggccgcaagagcatcgcgctggacctggtcaccgagatcgggcgggtgccctcccacctcgcccaccgcacccggaacgccctggacaacctggtgatgctccacaccagcgagcacggcgggaaggcctaccgccacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccaccaagcgcgacctgggcatgtccaaggagccgggggtcgtgagccccacgtcctacctggacgtggacctccaccccgcgagcgcctggaccctgtacgccgtcgccaccaccgtgatcacgcccatgctgcggcacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcgcaccagctgggcgctctgcgaggccctgaccctggccacgggccccatcaccaccctctgggagggctcccccgggaagttctggaacaccacgatcgccgtgagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggccaaggaggggctgaagcggggcgagatcacccaccacgcggtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgccggcacccgccacgtgaacgcggagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgcggagtggctctggcgcacgctggggcggaacaagaagccccgcctgtgcacccgggaggagttcaccaagaaggtgcgcaccaacgccgccatgggcgccgtcttcacggaggagaaccagtgggactccgcgaaggccgccgtggaggacgaggacttctggatgctcgtggaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggccatctccggcgacgactgcgtcgtgaagcccatcgacgaccggttcgcgaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctccgggagaccgcgtgcctgggcaaggcctacgcccagatgtggagcctgatgtacttccaccgccgcgacctccggctggcctccaacgcgatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10114 - RNA, 9873 nt, synthetic construct
  misc_feature 1..9873: note = derived and/or modified CDS sequence (opt1) from DENV-3__KF955468__SS-prME
  source 1..9873: mol_type = other RNA
accagcctgtgcctcatgatgatcctgcccgcggccctggcgttccacctcaccagccgggacggcgagccgcggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcctgaccctgaccgtggcctggcgcacggccaccctcatcctggccggggtcagcctgctcccggtgtgccagtccagctccatgcggaagaccgactggctgcccatgaccgtggcggccatgggcgtgccgcccctgcccctgttcatcttcagcctgaaggacacgctgaagcgccgctcctggcccctcaacgagggggtgatggccgtgggcctggtcagcatcctggcctccagcctcctgcggaacgacgtgcccatggccggccccctggtggccggcgggctcctgatcgcctgctacgtcatcaccgggacctccgccgacctgaccgtggagaaggccgccgacgtgacgtgggaggaggaggcggagcagaccggggtcagccacaacctcatgatcaccgtggacgacgacgggaccatgcgcatcaaggacgacgagaccgagaacatcctgacggtgctgctcaagaccgccctgctgatcgtctccggcatcttcccgtacagcatccccgccaccctcctggtgtggcacacctggcagaagcagacgcagcggtccggcgtgctgtgggacgtccccagcccgcccgagacccagaaggccgagctcgaggagggggtgtaccgcatcaagcagcagggcatcttcgggaagacccaggtgggcgtcggggtgcagaaggagggcgtgttccacaccatgtggcacgtcacgcggggcgccgtgctgacctacaacgggaagcgcctggagcccaactgggcgtccgtgaagaaggacctcatcagctacggcgggggctggcggctgtccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggccgggtcgtggggctgtacggcaacggggtggtcacgaagaacggcgggtacgtgtccggcatcgcccagaccaacgccgagccggacggccccacccccgagctcgaggaggagatgttcaagaagcgcaacctgaccatcatggacctgcaccccgggagcggcaagacgcggaagtacctcccggccatcgtgcgcgaggccatcaagcggcgcctgcggaccctgatcctcgcgcccacccgcgtcgtggccgccgagatggaggaggccctgaaggggctgcccatccggtaccagaccacggccaccaagtccgagcacaccggccgcgagatcgtggacctcatgtgccacgcgaccttcacgatgcggctgctgagccccgtccgcgtgccgaactacaacctcatcatcatggacgaggcccacttcaccgaccccgcctccatcgccgcccgggggtacatcagcacccgcgtgggcatgggcgaggcggccgccatcttcatgaccgccacgccgcccgggaccgcggacgccttcccgcagtccaacgcccccatccaggacgaggagcgcgacatccccgagcggagctggaactccggcaacgagtggatcaccgacttcgccgggaagaccgtctggttcgtgcccagcatcaaggccggcaacgacatcgcgaactgcctgcgcaagaacgggaagaaggtgatccagctgtcccggaagacgttcgacaccgagtaccagaagaccaagctcaacgactgggacttcgtcgtgaccacggacatcagcgagatgggcgccaacttcaaggccgaccgcgtgatcgacccgcggcgctgcctgaagcccgtcatcctgaccgacggccccgagcgggtgatcctcgccgggcccatgccggtgaccgccgcgtccgccgcccagcgccggggccgcgtcgggcggaacccccagaaggagaacgaccagtacatcttcaccggccagcccctgaacaacgacgaggaccacgcccactggaccgaggccaagatgctgctcgacaacatcaacacgcccgaggggatcatcccggcgctgttcgagcccgagcgcgagaagtccgccgccatcgacggcgagtaccggctgaagggcgagtcccgcaagaccttcgtggagctcatgcggcgcggggacctgcccgtctggctggcccacaaggtggcgagcgagggcatcaagtacaccgaccggaagtggtgcttcgacgggcagcgcaacaaccagatcctcgaggagaacatggacgtggagatctggaccaaggagggcgagaagaagaagctgcggccccgctggctggacgcccgcacgtactccgacccgctcgccctgaaggagttcaaggacttcgccgccggccgcaagagcatcgcgctggacctcgtcaccgagatcgggcgcgtgccctcccacctggcccaccggacccgcaacgccctggacaacctcgtgatgctgcacaccagcgagcacggcgggaaggcctaccggcacgccgtcgaggagctgcccgagacgatggagaccctcctgctgctcggcctgatgatcctgctcaccgggggcgcgatgctgttcctgatcagcggcaaggggatcggcaagacctccatcgggctcatctgcgtgatcgccagctccggcatgctgtggatggccgagatcccgctgcagtggatcgccagcgccatcgtgctcgagttcttcatgatggtcctgctgatccccgagcccgagaagcagcgcacgccccaggacaaccagctcgcgtacgtggtgatcgggatcctgaccctggccgccatcatcgccgccaacgagatgggcctcctggagaccaccaagcgggacctgggcatgtccaaggagccgggggtcgtgagccccacgtcctacctcgacgtggacctgcaccccgcgagcgcctggaccctgtacgccgtcgccaccaccgtgatcacgcccatgctccgccacaccatcgagaactccaccgcgaacgtgagcctggccgccatcgccaaccaggccgtcgtgctgatgggcctcgacaaggggtggccgatctccaagatggacctgggcgtgcccctgctcgcgctggggtgctacagccaggtcaaccccctgaccctcacggccgccgtgctgctgctcatcacccactacgccatcatcggccccggcctgcaggccaaggcgacccgggaggcccagaagcgcaccgccgccgggatcatgaagaacccgacggtggacggcatcatgaccatcgacctggaccccgtcatctacgactccaagttcgagaagcagctcggccaggtgatgctgctggtgctctgcgccgtccagctgctgctcatgcggaccagctgggcgctgtgcgaggccctgaccctcgccacgggccccatcaccaccctgtgggagggctcccccgggaagttctggaacaccacgatcgccgtgagcatggcgaacatcttccgcggctcctacctggccggggccggcctcgccttcagcatcatgaagtccgtggggaccggcaagcggggcaccgggagccagggcgagaccctgggggagaagtggaagaagaagctgaaccagctcagccgcaaggagttcgacctgtacaagaagtccggcatcaccgaggtcgaccggacggaggccaaggaggggctgaagcgcggcgagatcacccaccacgcggtgagccggggctccgccaagctccagtggttcgtggagcgcaacatggtcatcccggaggggcgggtgatcgacctgggctgcgggcgcggcgggtggagctactactgcgccggcctgaagaaggtgaccgaggtccggggctacaccaagggcgggcccgggcacgaggagcccgtgcccatgtccacgtacggctggaacatcgtgaagctcatgagcgggaaggacgtcttctacctgccgcccgagaagtgcgacaccctgctgtgcgacatcggcgagtccagcccctcccccaccgtggaggagagccgcaccatccgcgtgctcaagatggtcgagccgtggctgaagaacaaccagttctgcatcaaggtgctgaacccctacatgcccacggtgatcgagcacctcgagcggctgcagcgcaagcacggcgggatgctggtccggaaccccctctcccgcaacagcacccacgagatgtactggatctccaacggcaccgggaacatcgtggccagcgtgaacatggtctcccggctgctgctcaaccgcttcaccatgacgcaccggcgcccgaccatcgagaaggacgtggacctgggcgccggcacccggcacgtgaacgcggagcccgagacccccaacatggacgtcatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctcaccaagccctgggacgtggtccccatggtgacgcagatggccatgaccgacaccacccccttcgggcagcagcgcgtgttcaaggagaaggtcgacacgcggaccccgcgcagcatgcccggcacccggcgcgtgatgggcatcaccgcggagtggctgtggcggacgctggggcgcaacaagaagccccggctctgcacccgcgaggagttcaccaagaaggtgcgcaccaacgccgccatgggcgccgtcttcacggaggagaaccagtgggactccgcgaaggccgccgtggaggacgaggacttctggaccctggtggaccgggagcgcgagctgcacaagctcgggaagtgcggcagctgcgtctacaacatgatggggaagcgggagaagaagctgggcgagttcggcaaggccaaggggtcccgcgccatctggtacatgtggctgggcgcgcggtacctcgagttcgaggccctggggttcctgaacgaggaccactggttcagccgcgagaactcctacagcggcgtggagggggagggcctccacaagctgggctacatcctgcgggacatctccaagatccccgggggcgccatgtacgccgacgacaccgccgggtgggacacccgcatcacggaggacgacctccacaacgaggagaagatcacccagcagatggacccggagcaccggcagctggcgaacgccatcttcaagctgacctaccagaacaaggtggtcaaggtgcagcgccccacccccaccggcacggtgatggacatcatcagccggaaggaccagcgcggctccgggcaggtcggcacctacgggctcaacaccttcaccaacatggaggcccagctgatccggcagatggagggcgagggggtgctgagcaaggccgacctcgagaacccccacctcccggagaagaagatcacgcagtggctggagaccaagggcgtggagcgcctcaagcggatggccatctccggcgacgactgcgtcgtgaagcccatcgacgaccgcttcgcgaacgccctgctggccctcaacgacatggggaaggtgcggaaggacatcccccagtggcagcccagcaagggctggcacgactggcagcaggtcccgttctgctcccaccacttccacgagctgatcatgaaggacgggcgcaagctggtggtgccctgccggccccaggacgagctcatcggccgcgcccggatcagccagggggccggctggtccctgcgcgagaccgcgtgcctgggcaaggcctacgcccagatgtggagcctcatgtacttccaccgccgggacctgcgcctggcctccaacgcgatctgcagcgccgtccccgtgcactgggtgccgacctcccggacgacctggagcatccacgcccaccaccagtggatgaccaccgaggacatgctcacggtctggaaccgcgtgtggatcgaggacaacccctggatggaggacaagacccccgtgaccacctgggagaacgtcccctacctggggaagcgggaggaccagtggtgcggcagcctgatcgggctcacgtcccgcgccacctgggcccagaacatcccgaccgcgatccagcaggtccggagcctgatcggcaacgaggagttcctggactacatgccctccatgaagcgcttccggaaggaggaggagagcgagggggccatctggtga

SEQ ID NO: 10115 - RNA, 9873 nt, synthetic construct
  misc_feature 1..9873: note = derived and/or modified CDS sequence (opt1) from DENV-3__FJ744726__SS-prME
  source 1..9873: mol_type = other RNA
accagcctgtgcctcatgatgatgctgcccgccaccctggccttccacctcaccagccgggacggcgagccgcggatgatcgtggccaagaacgagcggggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccggacccagacctggatgagcgccgagggggcctggcgccaggtggagaaggtggagacgtgggcgctccggcacccgggcttcaccatcctggccctgttcctcgcccactacatcgggacctccctgacccagaaggtggtgatcttcatcctgctcatgctggtgacgcccagcatgaccatgcggtgcgtgggcgtggggaaccgggacttcgtcgagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcgagcccatcgagggcaaggtggtccagcacgagaacctgaagtacaccgtgatcatcacggtgcacaccggcgaccagcaccaggtcgggaacgacacccagggcgtgaccgtcgagatcacgccccaggccagcaccgtggaggcgatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcggctcccaggagggggcgatgcacaccgccctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtgtccgagacccagcacggcacgatcctgatcaaggtcgagtacaagggggaggacgcgccgtgcaagatccccttcagcaccgaggacggccaggggaaggcccacaacggccgcctgatcaccgccaaccccgtggtgaccaagaaggaggagcccgtcaacatcgaggccgagccgcccttcggcgagagcaacatcgtgatcgggatcggcgacaaggcgctcaagatcaactggtacaagaaggggtccagcatcggcaagatgttcgaggccacggcccgcggggcccgccggatggccatcctgggcgacaccgcgtgggacttcggctccgtcggcggggtcctgaacagcctcgggaagatggtgcaccagatcttcgggtccgcctacaccgccctgttcagcggggtgtcctggatcatgaagatcggcatcggcgtcctgctcacctggatcgggctgaacagcaagaacacgtccatgagcttctcctgcatcgtgatcggcatcatcaccctgtacctcggggccgtggtccaggccgacatgggctgcgtgatcaactggaaggggaaggagctgaagtgcggcagcggcatcttcgtgaccaacgaggtccacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtggtcgtgggcgacatcatcggggtgctggagcagggcaagcgcaccctcacgccccagccgatggagctgaagtactcctggaagacctggggcaaggccaagatcgtcacggccgagacccagaacagctccttcatcatcgacgggcccaacacccccgagtgccccagcgcctcccgggcgtggaacgtgtgggaggtggaggactacggcttcggggtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacggcagctggaagctggagaaggcgtccttcatcgaggtcaagacctgcacctggcccaagagccacaccctctggtccaacggggtgctggagagcgacatgatcatccccaagtccctggccggccccatcagccagcacaaccaccggccggggtaccacacgcagaccgccggcccctggcacctcgggaagctggagctggacttcaactactgcgagggcaccaccgtggtcatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggtcaagagcctggtctccgccggcagcggcaagatggacaacttcaccatggggatcctgtgcctcgccatcctgttcgaggaggtgatgcggggcaagttcgggaagaagcacatgatcgcgggcgtgctgttcaccttcgtcctcctgctgtccgggcagatcacgtggcgcgacatggcccacaccctcatcatgatcggcagcaacgcctccgaccggatgggcatgggggtgacctacctggccctgatcgccaccttcaagatccagcccttcctcgcgctgggcttcttcctgcgcaagctcacgagccgggagaacctgctgctcggggtgggcctggccatggccaccaccctgcagctccccgaggacatcgagcagatggccaacggcatcgcgctggggctgatgaccctcaagctgatcacgcagttcgagacctaccagctgtggaccgccctcgtcagcctgacctgctccaacacgatcttcaccctgaccgtggcctggcgcaccgccacgctcatcctggccggcgtgagcctgctcccgctgtgccagtccagctccatgcggaagaccgactggctgcccatgaccgtcgcggccatgggggtgccgcccctgccgctgttcatcttcagcctgaaggacacccccaagcgccgctcctggcccctcaacgagggcgtcatggccgtggggctggtgagcatcctggcctccagcctcctgcggaacgacgtccccatggccggcccgctggtggcgggcgggctcctgatcgcctgctacgtgatcacgggcacctccgccgacctgaccgtcgagaaggccgccgacgtgacctgggaggaggaggcggagcagacgggggtgagccacaacctcatgatcaccgtcgacgacgacggcaccatgcgcatcaaggacgacgagaccgagaacatcctgaccgtgctgctcaagacggccctgctgatcgtgtccgggatcttcccctacagcatccccgccaccctcctggtctggcacacctggcagaagcagacccagcggtccggcgtgctgtgggacgtgcccagcccgcccgagacgcagaaggccgagctcgaggagggcgtctaccgcatcaagcagcaggggatcttcggcaagacccaggtgggggtgggcgtccagaaggagggggtgttccacaccatgtggcacgtgacccggggcgccgtcctgacgcacaacggcaagcgcctggagcccaactgggcgtccgtgaagaaggacctcatcagctacgggggcgggtggcggctgtccgcccagtggcagaagggcgaggaggtgcaggtcatcgccgtggagcccgggaagaacccgaagaacttccagaccatgcccggcatcttccagaccaccacgggcgagatcggggccatcgcgctggacttcaagcccggcaccagcgggagcccgatcatcaaccgcgagggcaaggtggtcggcctgtacgggaacggcgtggtgaccaagaacgggggctacgtctccgggatcgcccagaccaacgccgagcccgacggccccacgcccgagctcgaggaggagatgttcaagaagcggaacctgaccatcatggacctgcacccgggcagcgggaagacccgcaagtacctccccgccatcgtgcgggaggccatcaagcgccggctgcgcaccctgatcctcgcgcccacgcgggtggtcgccgccgagatggaggaggccctgaagggcctgcccatccgctaccagaccaccgccatcaagtccgagcacaccgggcgggagatcgtggacctcatgtgccacgcgacgttcaccatgcgcctgctgagcccggtgcgggtccccaactacaacctcatcatcatggacgaggcccacttcaccgaccccgcctccatcgccgcccgcggctacatcagcacccgggtggggatgggcgaggcggccgccatcttcatgacggccacgccgcccggcaccgcggaggccttcccccagtccaacgcccccatccaggacgaggagaaggacatccccgagcgcagctggaactccgggaacgagtggatcaccgacttcgtgggcaagacggtctggttcgtgcccagcatcaaggccgggaacgacatcgccaactgcctgcgcaagaacggcaagaaggtgatccagctgtcccggaagaccttcgacaccgagtaccagaagacccgcctcaacgactgggacttcgtcgtgacgaccgacatcagcgagatgggggcgaacttcaaggccgaccgggtgatcgacccccgccggtgcctgaagcccgtcatcctgaccgacggccccgagcgcgtgatcctcgccggcccgatgcccgtgaccgccgcctccgcggcccagcggcgcgggcgggtcggccgcaacccccagaaggagaacgaccagtacatcttcacggggcagcccctgaacaacgacgaggaccacgcccactggaccgaggccaagatgctgctcgacaacatcaacaccccggagggcatcatccccgccctgttcgagcccgagcgggagaagtccgcggccatcgacggggagtaccgcctgaagggcgagtcccggaagaccttcgtggagctcatgcgccggggcgacctgcccgtgtggctggcccacaaggtcgccagcgaggggatcaagtacaccgaccgcaagtggtgcttcgacggcgagcggaacaaccagatcctcgaggagaacatggacgtggagatctggacgaaggagggggagcgcaagaagctgcggccgcgctggctggacgcgcgcacctactccgaccccctcgccctgaaggagttcaaggacttcgccgccggccgcaagagcatcgccctggacctcgtcaccgagatcggccgcgtgccctcccacctggcgcaccggacccgcaacgccctggacaacctcgtgatgctgcacacgagcgagcacgggggccgggcctaccgccacgccgtcgaggagctgccggagaccatggagaccctcctgctgctcgggctgatgatcctgctcaccggcggggccatgctgttcctgatcagcggcaagggcatcgggaagacgtccatcggcctcatctgcgtgatcgtgagctccgggatgctgtggatggcggacgtccccctgcagtggatcgccagcgccatcgtgctcgagttcttcatgatggtgctgctgatccccgagcccgagaagcagcggaccccgcaggacaaccagctcgcctacgtcgtgatcggcatcctgaccctggccgcgatcgtgaccgccaacgagatggggctcctggagacgaccaagcgcgacctgggcatgtccaaggagcccggcgtcgtgagccccacctcctacctcgacgtggacctgcaccccgccagcgcctggaccctgtacgccgtcgcgacgaccgtgatcaccccgatgctccggcacaccatcgagaactccacggccaacgtgagcctggccgccatcgcgaaccaggccgtcgtgctgatggggctcgacaagggctggcccatctccaagatggacctgggggtgcccctgctcgccctgggctgctacagccaggtcaaccccctgaccctcaccgccgccgtgctgctgctcgtgacccactacgcgatcatcgggccgggcctgcaggccaaggccacgcgcgaggcccagaagcggaccgccgcgggcatcatgaagaaccccaccgtcgacgggatcatgaccatcgacctggaccccgtgatctacgactccaagttcgagaagcagctcggccaggtgatgctgctggtcctctgcgccgtgcagctgctgctcatgcgcacgagctgggccctgtgcgaggccctgaccctcgccaccgggcccatcaccacgctgtgggagggctccccgggcaagttctggaacaccaccatcgcggtgagcatggccaacatcttccgggggtcctacctggccggcgccgggctcgcgttcagcatcatgaagtccgtcggcaccgggaagcgcggcacgggcagccagggggagaccctgggcgagaagtggaagaagaagctgaaccagctcagccggaaggagttcgacctgtacaagaagtccgggatcaccgaggtggaccgcaccgaggccaaggagggcctgaagcgcggggagaccacgcaccacgccgtgagccgcggctccgccaagctccagtggttcgtcgagcggaacatggtgatccccgagggccgcgtgatcgacctggggtgcggccgcgggggctggagctactactgcgccgggctgaagaaggtcaccgaggtgcgcggctacaccaagggcgggcccggccacgaggagcccgtgccgatgtccacctacgggtggaacatcgtcaagctcatgagcggcaaggacgtgttctacctgccgcccgagaagtgcgacacgctgctgtgcgacatcggggagtccagcccctccccgaccgtggaggagagccgcaccatccgggtcctcaagatggtggagccctggctgaagaacaaccagttctgcatcaaggtgctgaacccctacatgcccaccgtcatcgagcacctcgagcgcctgcagcggaagcacggcggcatgctggtgcgcaacccgctctcccggaacagcacgcacgagatgtactggatctccaacgggaccggcaacatcgtgagctccgtcaacatggtgagccgcctgctgctcaaccggttcaccatgacccaccgccggcccacgatcgagaaggacgtggacctgggggcgggcacccgccacgtcaacgccgagcccgagaccccgaacatggacgtgatcggcgagcggatcaagcgcatcaaggaggagcactccagcacctggcactacgacgacgagaacccctacaagacgtgggcctaccacgggtcctacgaggtcaaggccaccggcagcgccagctccatgatcaacggggtggtgaagctgctcaccaagccctgggacgtcgtgcccatggtgacccagatggcgatgacggacaccaccccgttcggccagcagcgggtcttcaaggagaaggtggacacccgcacgccccggcccatgcccgggacccgcaaggtgatggagatcaccgccgagtggctgtggcggaccctgggccgcaacaagcggccgcgcctctgcacgcgcgaggagttcaccaagaaggtccggaccaacgccgccatgggcgccgtgttcaccgaggagaaccagtgggacagcgcgcgcgccgccgtggaggacgaggagttctggaagctggtcgaccgggagcgcgagctgcacaagctcgggaagtgcggctcctgcgtgtacaacatgatggggaagcgggagaagaagctgggcgagttcgggaaggccaagggcagccgcgcgatctggtacatgtggctgggcgcccggtacctcgagttcgaggccctggggttcctgaacgaggaccactggttctcccgcgagaacagctactccggcgtggagggggagggcctccacaagctggggtacatcctgcgggacatcagcaagatccccggcggcgccatgtacgccgacgacacggcggggtgggacacccgcatcaccgaggacgacctccacaacgaggagaagatcacccagcagatggaccccgagcaccggcagctggccaacgccatcttcaagctgacgtaccagaacaaggtcgtgaaggtgcagcgccccaccccgaagggcaccgtcatggacatcatctcccggaaggaccagcgcgggagcggccaggtgggcacctacgggctcaacaccttcacgaacatggaggcccagctggtgcggcagatggagggcgagggggtcctgtccaaggtggacctcgagaacccccacctcctggagaagaagatcacccagtggctcgagaccaagggcgtggagcgcctgcggcgcatggccatcagcggggacgactgcgtcgtgaagcccatcgacgaccggttcgcgaacgccctgctcgccctgaacgacatgggcaaggtgcgcaaggacatcccccagtggcagccgtccaagggctggcacgactggcagcaggtccccttctgcagccaccacttccacgagctgatcatgaaggacgggcggaagctcgtggtgccctgccgcccccaggacgagctgatcggccgcgcccggatctcccagggggccggctggagcctgaaggagaccgcgtgcctcgggaaggcctacgcccagatgtggtccctgatgtacttccaccgccgggacctgcgcctcgccagcaacgccatctgctccgcggtcccggtgcactgggtgcccacgagccggaccacctggagcatccacgcccaccaccagtggatgaccacggaggacatgctgaccgtctggaaccgcgtgtggatcgaggacaacccctggatggaggacaagacccccgtgaccacgtgggaggacgtcccgtacctgggcaagcgggaggaccagtggtgcggctccctcatcgggctgaccagccgcgccacctgggcccagaacatcctgaccgcgatccagcaggtccggtccctcatcggcgacgaggagttcctggactacatgcccagcatgaagcgcttccggaaggaggaggagtccgagggggccatctggtga

SEQ ID NO: 10116 - RNA, 9873 nt, synthetic construct
  misc_feature 1..9873: note = derived and/or modified CDS sequence (opt1) from DENV-3__FJ744729__SS-prME
  source 1..9873: mol_type = other RNA
accagcctgtgcctcatgatgatgctgcccgccaccctggccttccacctcaccagccgggacggcgagccgcggatgatcgtggccaagaacgagcggggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccggacccagacctggatgagcgccgagggggcctggcgccaggtggagaaggtggagacgtgggcgctccgccacccgggcttcaccatcctggccctgttcctcgcccactacatcgggacctccctgacccagaaggtggtgatcttcatcctgctcatgctggtgacgcccagcatgaccatgcggtgcgtgggcgtggggaaccgcgacttcgtcgagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcaagcccatcgagggcaaggtggtccagcacgagaacctgaagtacaccgtgatcatcacggtgcacaccggcgaccagcaccaggtcgggaacgacacccagggcgtgaccgtcgagatcacgccccaggccagcaccgtggaggcgatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcggctcccaggagggggcgatgcacaccgccctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtgtccgagacccagcacggcacgatcctgatcaaggtcgagtacaagggggaggacgcgccgtgcaagatccccttcagcaccgaggacggccaggggaaggcccacaacggccgcctgatcaccgccaaccccgtggtgaccaagaaggaggagcccgtcaacatcgaggccgagccgcccttcggcgagagcaacatcgtgatcgggatcggcgacaaggcgctcaagatcaactggtacaagaaggggtccagcatcggcaagatgttcgaggccacggcccgcggggcccgccggatggccatcctgggcgacaccgcgtgggacttcggctccgtcggcggggtcctgaacagcctcgggaagatggtgcaccagatcttcgggtccgcctacaccgccctgttcagcggggtgtcctggatcatgaagatcggcatcggcgtcctgctcacctggatcgggctgaacagcaagaacacgtccatgagcttctcctgcatcgtgatcggcatcatcaccctgtacctcggggccgtggtccaggccgacatgggctgcgtgatcaactggaaggggaaggagctgaagtgcggcagcggcatcttcgtgaccaacgaggtccacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtggtcgtgggcgacatcatcggggtgctggagcagggcaagcgcaccctcacgccccagccgatggagctgaagtactcctggaagacctggggcaaggccaagatcgtcacggccgagacccagaacagctccttcatcatcgacgggcccaacacccccgagtgccccagcgcctcccgggcgtggaacgtgtgggaggtggaggactacggcttcggggtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacggcagctggaagctggagaaggcgtccttcatcgaggtcaagacctgcacctggcccaagagccacaccctctggtccaacggggtgctggagagcgacatgatcatccccaagtccctggccggccccatcagccagcacaaccaccggccggggtaccacacgcagaccgccggcccctggcacctcgggaagctggagctggacttcaactactgcgagggcaccaccgtggtcatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggtcaagagcctggtctccgccggcagcggcaagatggacaacttcaccatggggatcctgtgcctcgccatcctgttcgaggaggtgatgcggggcaagttcgggaagaagcacatgatcgcgggcgtgctgttcaccttcgtcctcctgctgtccgggcagatcacgtggcgcgacatggcccacaccctcatcatgatcggcagcaacgcctccgaccggatgggcatgggggtgacctacctggccctgatcgccaccttcaagatccagcccttcctcgcgctgggcttcttcctgcgcaagctcacgagccgggagaacctgctgctcggggtgggcctggccatggccaccaccctgcagctccccgaggacatcgagcagatggccaacggcatcgcgctggggctgatgaccctcaagctgatcacgcagttcgagacctaccagctgtggaccgccctcgtcagcctgacctgctccaacacgatcttcaccctgaccgtggcctggcgcaccgccacgctcatcctggccggcgtgagcctgctcccgctgtgccagtccagctccatgcggaagaccgactggctgcccatgaccgtcgcggccatgggggtgccgcccctgccgctgttcatcttcagcctgaaggacacccccaagcgccgctcctggcccctcaacgagggcgtcatggccgtggggctggtgagcatcctggcctccagcctcctgcggaacgacgtccccatggccggcccgctggtggcgggcgggctcctgatcgcctgctacgtgatcacgggcacctccgccgacctgaccgtcgagaaggccgccgacgtgacctgggaggaggaggcggagcagacgggggtgagccacaacctcatgatcaccgtcgacgacgacggcaccatgcgcatcaaggacgacgagaccgagaacatcctgaccgtgctgctcaagacggccctgctgatcgtgtccgggatcttcccctacagcatccccgccaccctcctggtctggcacacctggcagaagcagacccagcggtccggcgtgctgtgggacgtgcccagcccgcccgagacgcagaaggccgagctcgaggagggcgtctaccgcatcaagcagcaggggatcttcggcaagacccaggtgggggtgggcgtccagaaggagggggtgttccacaccatgtggcacgtgacccggggcgccgtcctgacgcacaacggcaagcgcctggagcccaactgggcgtccgtgaagaaggacctcatcagctacgggggcgggtggcggctgtccgcccagtggcagaagggcgaggaggtgcaggtcatcgccgtggagcccgggaagaacccgaagaacttccagaccatgcccggcatcttccagaccaccacgggcgagatcggggccatcgcgctggacttcaagcccggcaccagcgggagcccgatcatcaaccgcgagggcaaggtggtcggcctgtacgggaacggcgtggtgaccaagaacgggggctacgtctccgggatcgcccagaccaacgccgagcccgacggccccacgcccgagctcgaggaggagatgttcaagaagcggaacctgaccatcatggacctgcacccgggcagcgggaagacccgcaagtacctccccgccatcgtgcgggaggccatcaagcgccggctgcgcaccctgatcctcgcgcccacgcgggtggtcgccgccgagatggaggaggccctgaagggcctgcccatccgctaccagaccaccgccatcaagtccgagcacaccgggcgggagatcgtggacctcatgtgccacgcgacgttcaccatgcgcctgctgagcccggtgcgggtccccaactacaacctcatcatcatggacgaggcccacttcaccgaccccgcctccatcgccgcccgcggctacatcagcacccgggtggggatgggcgaggcggccgccatcttcatgacggccacgccgcccggcaccgcggaggccttcccccagtccaacgcccccatccaggacgaggagcgcgacatccccgagcgcagctggaactccgggaacgagtggatcaccgacttcgtgggcaagacggtctggttcgtgcccagcatcaaggccgggaacgacatcgccaactgcctgcggaagaacggcaagaaggtgatccagctgtcccgcaagaccttcgacaccgagtaccagaagacccggctcaacgactgggacttcgtcgtgacgaccgacatcagcgagatgggggcgaacttcaaggccgaccgcgtgatcgacccccggcgctgcctgaagcccgtcatcctgaccgacggccccgagcgggtgatcctcgccggcccgatgcccgtgaccgccgcctccgcggcccagcgccgggggcgcgtcggccggaacccccagaaggagaacgaccagtacatcttcacggggcagcccctgaacaacgacgaggaccacgcccactggaccgaggccaagatgctgctcgacaacatcaacaccccggagggcatcatccccgccctgttcgagcccgagcgcgagaagtccgcggccatcgacggggagtaccggctgaagggcgagtcccgcaagaccttcgtggagctcatgcggcgcggcgacctgcccgtgtggctggcccacaaggtcgccagcgaggggatcaagtacaccgaccggaagtggtgcttcgacggcgagcgcaacaaccagatcctcgaggagaacatggacgtggagatctggacgaaggagggggagcggaagaagctgcgcccgcgctggctggacgcgcggacctactccgaccccctcgccctgaaggagttcaaggacttcgccgccggccgcaagagcatcgccctggacctcgtcaccgagatcggccgggtgccctcccacctggcgcaccgcacccggaacgccctggacaacctcgtgatgctgcacacgagcgagcacgggggccgcgcctaccggcacgccgtcgaggagctgccggagaccatggagaccctcctgctgctcgggctgatgatcctgctcaccggcggggccatgctgttcctgatcagcggcaagggcatcgggaagacgtccatcggcctcatctgcgtgatcgtgagctccgggatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcggcatcctgaccctggccgcgatcgtgaccgccaacgagatggggctcctggagacgaccaagcgggacctgggcatgtccaaggagcccggcgtcgtgagccccacctcctacctcgacgtggacctgcaccccgccagcgcctggaccctgtacgccgtcgcgacgaccgtgatcaccccgatgctccgccacaccatcgagaactccacggccaacgtgagcctggccgccatcgcgaaccaggccgtcgtgctgatggggctcgacaagggctggcccatctccaagatggacctgggggtgcccctgctcgccctgggctgctacagccaggtcaaccccctgaccctcaccgccgccgtgctgctgctcgtgacccactacgcgatcatcgggccgggcctgcaggccaaggccacgcgggaggcccagaagcgcaccgccgcgggcatcatgaagaaccccaccgtcgacgggatcatgaccatcgacctggaccccgtgatctacgactccaagttcgagaagcagctcggccaggtgatgctgctggtcctctgcgccgtgcagctgctgctcatgcggacgagctgggccctgtgcgaggccctgaccctcgccaccgggcccatcaccacgctgtgggagggctccccgggcaagttctggaacaccaccatcgcggtgagcatggccaacatcttccgcgggtcctacctggccggcgccgggctcgcgttcagcatcatgcggtccgtcggcaccgggaagcgcggcacgggcagccagggggagaccctgggcgagaagtggaagaagaagctgaaccagctcagccggaaggagttcgacctgtacaagaagtccgggatcaccgaggtggaccgcaccgaggccaaggagggcctgaagcgcggggagaccacgcaccacgccgtgagccgcggctccgccaagctccagtggttcgtcgagcggaacatggtgatccccgagggccgcgtgatcgacctggggtgcggccgcgggggctggagctactactgcgccgggctgaagaaggtcaccgaggtgcggggctacaccaagggcgggcccggccacgaggagcccgtgccgatgtccacctacgggtggaacatcgtcaagctcatgagcggcaaggacgtgttctacctgccgcccgagaagtgcgacacgctgctgtgcgacatcggggagtccagcccctccccgaccgtggaggagagccgcaccatccgggtcctcaagatggtggagccctggctgaagaacaaccagttctgcatcaaggtgctgaacccctacatgcccaccgtcatcgagcacctcgagcgcctgcagcggaagcacggcggcatgctggtgcgcaacccgctctcccggaacagcacgcacgagatgtactggatctccaacgggaccggcaacatcgtgagctccgtcaacatggtgagccgcctgctgctcaaccggttcaccatgacccaccgccggcccacgatcgagaaggacgtggacctgggggcgggcacccgccacgtcaacgccgagcccgagaccccgaacatggacgtgatcggcgagcggatcaagcgcatcaaggaggagcactccagcacctggcactacgacgacgagaacccctacaagacgtgggcctaccacgggtcctacgaggtcaaggccaccggcagcgccagctccatgatcaacggggtggtgaagctgctcaccaagccctgggacgtcgtgcccatggtgacccagatggcgatgacggacaccaccccgttcggccagcagcgggtcttcaaggagaaggtggacacccgcacgccccggcccatgcccgggacccgcaaggtgatggagatcaccgccgagtggctgtggcggaccctgggccgcaacaagcgcccgcggctctgcacgcgcgaggagttcaccaagaaggtccggaccaacgccgccatgggcgccgtgttcaccgaggagaaccagtgggacagcgcgcgcgccgccgtggaggacgaggagttctggaagctggtcgaccgggagcgcgagctgcacaagctcgggaagtgcggctcctgcgtgtacaacatgatggggaagcgggagaagaagctgggcgagttcgggaaggccaagggcagccgcgcgatctggtacatgtggctgggcgcccggtacctcgagttcgaggccctggggttcctgaacgaggaccactggttctcccgcgagaacagctactccggcgtggagggggagggcctccacaagctggggtacatcctgcgggacatcagcaagatccccggcggcgccatgtacgccgacgacacggcggggtgggacacccgcatcaccgaggacgacctccacaacgaggagaagatcacccagcagatggaccccgagcaccggcagctggccaacgccatcttcaagctgacgtaccagaacaaggtcgtgaaggtgcagcgccccaccccgaagggcaccgtcatggacatcatctcccggaaggaccagcgcgggagcggccaggtgggcacctacgggctcaacaccttcacgaacatggaggcccagctggtgcggcagatggagggcgagggggtcctgtccaaggtggacctcgagaacccccacctcctggagaagaagatcacccagtggctcgagaccaagggcgtggagcgcctgcggcgcatggccatcagcggggacgactgcgtcgtgaagcccatcgacgaccggttcgcgaacgccctgctcgccctgaacgacatgggcaaggtgcgcaaggacatcccccagtggcagccgtccaagggctggcacgactggcagcaggtccccttctgcagccaccacttccacgagctgatcatgaaggacgggcgcaagctcgtggtgccctgccggccccaggacgagctgatcggccgcgcccggatctcccagggggccggctggagcctgaaggagaccgcgtgcctcgggaaggcctacgcccagatgtggtccctgatgtacttccaccgccgggacctgcgcctcgccagcaacgccatctgctccgcggtcccggtgcactgggtgcccacgagccggaccacctggagcatccacgcccaccaccagtggatgaccacggaggacatgctgaccgtctggaaccgcgtgtggatcgaggacaacccctggatggaggacaagacccccgtgaccacgtgggaggacgtcccgtacctgggcaagcgggaggaccagtggtgcggctccctcatcgggctgaccagccgcgccacctgggcccagaacatcctgaccgcgatccagcaggtccggtccctcatcggcgacgaggagttcctggactacatgcccagcatgaagcgcttccggaaggaggaggagtccgagggggccatctggtga

SEQ ID NO: 10117 - RNA, 9873 nt, synthetic construct
  misc_feature 1..9873: note = derived and/or modified CDS sequence (opt1) from DENV-3__FJ687448__SS-prME
  source 1..9873: mol_type = other RNA
accagcctgtgcctcatgatgatgctgcccgccaccctggccttccacctcaccagccgggacggcgagccgcggatgatcgtggccaagaacgagcggggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccgcacccagacctggatgagcgccgagggggcctggcgccaggtggagaaggtggagacgtgggcgctccgccacccgggcttcaccatcctggccctgttcctcgcccactacatcgggacctccctgacccagaaggtggtgatcttcatcctgctcatgctggtgacgcccagcatgaccatgcggtgcgtgggcgtggggaaccgcgacttcgtcgagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcgagcccatcgagggcaaggtggtccagcacgagaacctgaagtacaccgtgatcatcacggtgcacaccggcgaccagcaccaggtcgggaacgacacccagggcgtgaccgtcgagatcacgccccaggccagcaccgtggaggcgatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcggctcccaggagggggcgatgcacaccgccctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtgtccgagacccagcacggcacgatcctgatcaaggtcgagtacaagggggaggacgcgccgtgcaagatccccttcagcaccgaggacggccaggggaaggcccacaacggccgcctgatcaccgccaaccccgtggtgaccaagaaggaggagcccgtcaacatcgaggccgagccgcccttcggcgagagcaacatcgtgatcgggatcggcgacaaggcgctcaagatcaactggtacaagaaggggtccagcatcggcaagatgttcgaggccacggcccgcggggcccgccggatggccatcctgggcgacaccgcgtgggacttcggctccgtcggcggggtcctgaacagcctcgggaagatggtgcaccagatcttcgggtccgcctacaccgccctgttcagcggggtgtcctggatcatgaagatcggcatcggcgtcctgctcacctggatcgggctgaacagcaagaacacgtccatgagcttctcctgcatcgtgatcggcatcatcaccctgtacctcggggccgtggtccaggccgacatgggctgcgtgatcaactggaaggggaaggagctgaagtgcggcagcggcatcttcgtgaccaacgaggtccacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtggtcgtgggcgacatcatcggggtgctggagcagggcaagcgcaccctcacgccccagccgatggagctgaagtactcctggaagacctggggcaaggccaagatcgtcacggccgagacccagaacagctccttcatcatcgacgggcccaacacccccgagtgccccagcgcctcccgggcgtggaacgtgtgggaggtggaggactacggcttcggggtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacggcagctggaagctggagaaggcgtccttcatcgaggtcaagacctgcacctggcccaagagccacaccctctggtccaacggggtgctggagagcgacatgatcatccccaagtccctggccggccccatcagccagcacaaccaccggccggggtaccacacgcagaccgccggcccctggcacctcgggaagctggagctggacttcaactactgcgagggcaccaccgtggtcatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggtcaagagcctggtctccgccggcagcggcaagatggacaacttcaccatggggatcctgtgcctcgccatcctgttcgaggaggtgatgcggggcaagttcgggaagaagcacatgatcgcgggcgtgctgttcaccttcgtcctcctgctgtccgggcagatcacgtggcgcgacatggcccacaccctcatcatgatcggcagcaacgcctccgaccggatgggcatgggggtgacctacctggccctgatcgccaccttcaagatccagcccttcctcgcgctgggcttcttcctgcgcaagctcacgagccgggagaacctgctgctcggggtgggcctggccatggccaccaccctgcagctccccgaggacatcgagcagatggccaacggcatcgcgctggggctgatgaccctcaagctgatcacgcagttcgagacctaccagctgtggaccgccctcgtcagcctgacctgctccaacacgatcttcaccctgaccgtggcctggcgcaccgccacgctcatcctggccggcgtgagcctgctcccgctgtgccagtccagctccatgcggaagaccgactggctgcccatgaccgtcgcggccatgggggtgccgcccctgccgctgttcatcttcagcctgaaggacacccccaagcgccgctcctggcccctcaacgagggcgtcatggccgtggggctggtgagcatcctggcctccagcctcctgcggaacgacgtccccatggccggcccgctggtggcgggcgggctcctgatcgcctgctacgtgatcacgggcacctccgccgacctgaccgtcgagaaggccgccgacgtgacctgggaggaggaggcggagcagacgggggtgagccacaacctcatgatcaccgtcgacgacgacggcaccatgcgcatcaaggacgacgagaccgagaacatcctgaccgtgctgctcaagacggccctgctgatcgtgtccgggatcttcccctacagcatccccgccaccctcctggtctggcacacctggcagaagcagacccagcggtccggcgtgctgtgggacgtgcccagcccgcccgagacgcagaaggccgagctcgaggagggcgtctaccgcatcaagcagcaggggatcttcggcaagacccaggtgggggtgggcgtccagaaggagggggtgttccacaccatgtggcacgtgacccggggcgccgtcctgacgcacaacggcaagcgcctggagcccaactgggcgtccgtgaagaaggacctcatcagctacgggggcgggtggcggctgtccgcccagtggcagaagggcgaggaggtgcaggtcatcgccgtggagcccgggaagaacccgaagaacttccagaccatgcccggcatcttccagaccaccacgggcgagatcggggccatcgcgctggacttcaagcccggcaccagcgggagcccgatcatcaaccgcgagggcaaggtggtcggcctgtacgggaacggcgtggtgaccaagaacgggggctacgtctccgggatcgcccagaccaacgccgagcccgacggccccacgcccgagctcgaggaggagatgttcaagaagcggaacctgaccatcatggacctgcacccgggcagcgggaagacccgcaagtacctccccgccatcgtgcgggaggccatcaagcgccggctgcgcaccctgatcctcgcgcccacgcgggtggtcgccgccgagatggaggaggccctgaagggcctgcccatccgctaccagaccaccgccatcaagtccgagcacaccgggcgggagatcgtggacctcatgtgccacgcgacgttcaccatgcgcctgctgagcccggtgcgggtccccaactacaacctcatcatcatggacgaggcccacttcaccgaccccgcctccatcgccgcccgcggctacatcagcacccgggtggggatgggcgaggcggccgccatcttcatgacggccacgccgcccggcaccgcggaggccttcccccagtccaacgcccccatccaggacgaggagcgcgacatccccgagcgcagctggaactccgggaacgagtggatcaccgacttcgtgggcaagacggtctggttcgtgcccagcatcaaggccgggaacgacatcgccaactgcctgcggaagaacggcaagaaggtgatccagctgtcccgcaagaccttcgacaccgagtaccagaagacccggctcaacgactgggacttcgtcgtgacgaccgacatcagcgagatgggggcgaacttcaaggccgaccgcgtgatcgacccccggcgctgcctgaagcccgtcatcctgaccgacggccccgagcgggtgatcctcgccggcccgatgcccgtgaccgccgcctccgcggcccagcgccgggggcgcgtcggccggaacccccagaaggagaacgaccagtacatcttcacggggcagcccctgaacaacgacgaggaccacgcccactggaccgaggccaagatgctgctcgacaacatcaacaccccggagggcatcatccccgccctgttcgagcccgagcgcgagaagtccgcggccatcgacggggagtaccggctgaagggcgagtcccgcaagaccttcgtggagctcatgcggcgcggcgacctgcccgtgtggctggcccacaaggtcgccagcgaggggatcaagtacaccgaccggaagtggtgcttcgacggcgagcgcaacaaccagatcctcgaggagaacatggacgtggagatctggacgaaggagggggagcggaagaagctgcgcccgcgctggctggacgcgcggacctactccgaccccctcgccctgaaggagttcaaggacttcgccgccggccgcaagagcatcgccctggacctcgtcaccgagatcggccgggtgccctcccacctggcgcaccgcacccggaacgccctggacaacctcgtgatgctgcacacgagcgagcacgggggccgcgcctaccggcacgccgtcgaggagctgccggagaccatggagaccctcctgctgctcgggctgatgatcctgctcaccggcggggccatgctgttcctgatcagcggcaagggcatcgggaagacgtccatcggcctcatctgcgtgatcgtgagctccgggatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcggcatcctgaccctggccgcgatcgtgaccgccaacgagatggggctcctggagacgaccaagcgggacctgggcatgtccaaggagcccggcgtcgtgagccccacctcctacctcgacgtggacctgcaccccgccagcgcctggaccctgtacgccgtcgcgacgaccgtgatcaccccgatgctccgccacaccatcgagaactccacggccaacgtgagcctggccgccatcgcgaaccaggccgtcgtgctgatggggctcgacaagggctggcccatctccaagatggacctgggggtgcccctgctcgccctgggctgctacagccaggtcaaccccctgaccctcaccgccgccgtgctgctgctcgtgacccactacgcgatcatcgggccgggcctgcaggccaaggccacgcgggaggcccagaagcgcaccgccgcgggcatcatgaagaaccccaccgtcgacgggatcatgaccatcgacctggaccccgtgatctacgactccaagttcgagaagcagctcggccaggtgatgctgctggtcctctgcgccgtgcagctgctgctcatgcggacgagctgggccctgtgcgaggccctgaccctcgccaccgggcccatcaccacgctgtgggagggctccccgggcaagttctggaacaccaccatcgcggtgagcatggccaacatcttccgcgggtcctacctggccggcgccgggctcgcgttcagcatcatgaagtccgtcggcaccgggaagcggggcacgggcagccagggggagaccctgggcgagaagtggaagaagaagctgaaccagctcagccgcaaggagttcgacctgtacaagaagtccgggatcaccgaggtggaccggaccgaggccaaggagggcctgaagcgcggggagaccacgcaccacgccgtgagccggggctccgccaagctccagtggttcgtcgagcgcaacatggtgatccccgagggccgggtgatcgacctggggtgcggccgcgggggctggagctactactgcgccgggctgaagaaggtcaccgaggtgcgcggctacaccaagggcgggcccggccacgaggagcccgtgccgatgtccacctacgggtggaacatcgtcaagctcatgagcggcaaggacgtgttctacctgccgcccgagaagtgcgacacgctgctgtgcgacatcggggagtccagcccctccccgaccgtggaggagagccggaccatccgcgtcctcaagatggtggagccctggctgaagaacaaccagttctgcatcaaggtgctgaacccctacatgcccaccgtcatcgagcacctcgagcggctgcagcgcaagcacggcggcatgctggtgcggaacccgctctcccgcaacagcacgcacgagatgtactggatctccaacgggaccggcaacatcgtgagctccgtcaacatggtgagccggctgctgctcaaccgcttcaccatgacccaccggcgccccacgatcgagaaggacgtggacctgggggcgggcacccggcacgtcaacgccgagcccgagaccccgaacatggacgtgatcggcgagcgcatcaagcggatcaaggaggagcactccagcacctggcactacgacgacgagaacccctacaagacgtgggcctaccacgggtcctacgaggtcaaggccaccggcagcgccagctccatgatcaacggggtggtgaagctgctcaccaagccctgggacgtcgtgcccatggtgacccagatggcgatgacggacaccaccccgttcggccagcagcgcgtcttcaaggagaaggtggacacccggacgccccgccccatgcccgggacccggaaggtgatggagatcaccgccgagtggctgtggcgcaccctgggccggaacaagcgcccgcgcctctgcacgcgggaggagttcaccaagaaggtccgcaccaacgccgccatgggcgccgtgttcaccgaggagaaccagtgggacagcgcgcgggccgccgtggaggacgaggagttctggaagctggtcgaccgcgagcgggagctgcacaagctcgggaagtgcggctcctgcgtgtacaacatgatggggaagcgcgagaagaagctgggcgagttcgggaaggccaagggcagccgggcgatctggtacatgtggctgggcgcccgctacctcgagttcgaggccctggggttcctgaacgaggaccactggttctcccgggagaacagctactccggcgtggagggggagggcctccacaagctggggtacatcctgcgcgacatcagcaagatccccggcggcgccatgtacgccgacgacacggcggggtgggacacccggatcaccgaggacgacctccacaacgaggagaagatcacccagcagatggaccccgagcaccgccagctggccaacgccatcttcaagctgacgtaccagaacaaggtcgtgaaggtgcagcggcccaccccgaagggcaccgtcatggacatcatctcccgcaaggaccagcgggggagcggccaggtgggcacctacgggctcaacaccttcacgaacatggaggcccagctggtgcgccagatggagggcgagggggtcctgtccaaggtggacctcgagaacccccacctcctggagaagaagatcacccagtggctcgagaccaagggcgtggagcggctgcgccggatggccatcagcggggacgactgcgtcgtgaagcccatcgacgaccgcttcgcgaacgccctgctcgccctgaacgacatgggcaaggtgcggaaggacatcccccagtggcagccgtccaagggctggcacgactggcagcaggtccccttctgcagccaccacttccacgagctgatcatgaaggacgggcgcaagctcgtggtgccctgccgcccccaggacgagctgatcggccgggcccgcatctcccagggggccggctggagcctgaaggagaccgcgtgcctcgggaaggcctacgcccagatgtggtccctgatgtacttccaccggcgcgacctgcggctcgccagcaacgccatctgctccgcggtcccggtgcactgggtgcccacgagccgcaccacctggagcatccacgcccaccaccagtggatgaccacggaggacatgctgaccgtctggaaccgggtgtggatcgaggacaacccctggatggaggacaagacccccgtgaccacgtgggaggacgtcccgtacctgggcaagcgcgaggaccagtggtgcggctccctcatcgggctgaccagccgggccacctgggcccagaacatcctgaccgcgatccagcaggtccgctccctcatcggcgacgaggagttcctggactacatgcccagcatgaagcggttccgcaaggaggaggagtccgagggggccatctggtga

SEQ ID NO: 10118 - RNA, 9873 nt, synthetic construct
  misc_feature 1..9873: note = derived and/or modified CDS sequence (opt1) from DENV-3__FJ744732__SS-prME
  source 1..9873: mol_type = other RNA
accagcctgtgcctcatgatgatgctgcccgccaccctggccttccacctcaccagccgggacggcgagccgcggatgatcgtggccaagaacgagcggggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccgcacccagacctggatgagcgccgagggggcctggcgccaggtggagaaggtggagacgtgggcgctccgccacccgggcttcaccatcctggccctgttcctcgcccactacatcgggacctccctgacccagaaggtggtgatcttcatcctgctcatgctggtgacgcccagcatgaccatgcggtgcgtgggcgtggggaaccgcgacttcgtcgagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcgagcccatcgagggcaaggtggtccagcacgagaacctgaagtacaccgtgatcatcacggtgcacaccggcgaccagcaccaggtcgggaacgacacccagggcgtgaccgtcgagatcacgccccaggccagcaccgtggaggcgatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcggctcccaggagggggcgatgcacaccgccctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtgtccgagacccagcacggcacgatcctgatcaaggtcgagtacaagggggaggacgcgccgtgcaagatccccttcagcaccgaggacggccaggggaaggcccacaacggccgcctgatcaccgccaaccccgtggtgaccaagaaggaggagcccgtcaacatcgaggccgagccgcccttcggcgagagcaacatcgtgatcgggatcggcgacaaggcgctcaagatcaactggtacaagaaggggtccagcatcggcaagatgttcgaggccacggcccgcggggcccgccggatggccatcctgggcgacaccgcgtgggacttcggctccgtcggcggggtcctgaacagcctcgggaagatggtgcaccagatcttcgggtccgcctacaccgccctgttcagcggggtgtcctggatcatgaagatcggcatcggcgtcctgctcacctggatcgggctgaacagcaagaacacgtccatgagcttctcctgcatcgtgatcggcatcatcaccctgtacctcggggccgtggtccaggccgacatgggctgcgtgatcaactggaaggggaaggagctgaagtgcggcagcggcatcttcgtgaccaacgaggtccacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtggtcgtgggcgacatcatcggggtgctggagcagggcaagcgcaccctcacgccccagccgatggagctgaagtactcctggaagacctggggcaaggccaagatcgtcacggccgagacccagaacagctccttcatcatcgacgggcccaacacccccgagtgccccagcgcctcccgggcgtggaacgtgtgggaggtggaggactacggcttcggggtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacggcagctggaagctggagaaggcgtccttcatcgaggtcaagacctgcacctggcccaagagccacaccctctggtccaacggggtgctggagagcgacatgatcatccccaagtccctggccggccccatcagccagcacaaccaccggccggggtaccacacgcagaccgccggcccctggcacctcgggaagctggagctggacttcaactactgcgagggcaccaccgtggtcatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggtcaagagcctggtctccgccggcagcggcaagatggacaacttcaccatggggatcctgtgcctcgccatcctgttcgaggaggtgatgcggggcaagttcgggaagaagcacatgatcgcgggcgtgctgttcaccttcgtcctcctgctgtccgggcagatcacgtggcgcgacatggcccacaccctcatcatgatcggcagcaacgcctccgaccggatgggcatgggggtgacctacctggccctgatcgccaccttcaagatccagcccttcctcgcgctgggcttcttcctgcgcaagctcacgagccgggagaacctgctgctcggggtgggcctggccatggccaccaccctgcagctccccgaggacatcgagcagatggccaacggcatcgcgctggggctgatgaccctcaagctgatcacgcagttcgagacctaccagctgtggaccgccctcgtcagcctgacctgctccaacacgatcttcaccctgaccgtggcctggcgcaccgccacgctcatcctggccggcgtgagcctgctcccgctgtgccagtccagctccatgcggaagaccgactggctgcccatgaccgtcgcggccatgggggtgccgcccctgccgctgttcatcttcagcctgaaggacacccccaagcgccgctcctggcccctcaacgagggcgtcatggccgtggggctggtgagcatcctggcctccagcctcctgcggaacgacgtccccatggccggcccgctggtggcgggcgggctcctgatcgcctgctacgtgatcacgggcacctccgccgacctgaccgtcgagaaggccgccgacgtgacctgggaggaggaggcggagcagacgggggtgagccacaacctcatgatcaccgtcgacgacgacggcaccatgcgcatcaaggacgacgagaccgagaacatcctgaccgtgctgctcaagacggccctgctgatcgtgtccgggatcttcccctacagcatccccgccaccctcctggtctggcacacctggcagaagcagacccagcggtccggcgtgctgtgggacgtgcccagcccgcccgagacgcagaaggccgagctcgaggagggcgtctaccgcatcaagcagcaggggatcttcggcaagacccaggtgggggtgggcgtccagaaggagggggtgttccacaccatgtggcacgtgacccggggcgccgtcctgacgcacaacggcaagcgcctggagcccaactgggcgtccgtgaagaaggacctcatcagctacgggggcgggtggcggctgtccgcccagtggcagaagggcgaggaggtgcaggtcatcgccgtggagcccgggaagaacccgaagaacttccagaccatgcccggcatcttccagaccaccacgggcgagatcggggccatcgcgctggacttcaagcccggcaccagcgggagcccgatcatcaaccgcgagggcaaggtggtcggcctgtacgggaacggcgtggtgaccaagaacgggggctacgtctccgggatcgcccagaccaacgccgagcccgacggccccacgcccgagctcgaggaggagatgttcaagaagcggaacctgaccatcatggacctgcacccgggcagcgggaagacccgcaagtacctccccgccatcgtgcgggaggccatcaagcgccggctgcgcaccctgatcctcgcgcccacgcgggtggtcgccgccgagatggaggaggccctgaagggcctgcccatccgctaccagaccaccgccatcaagtccgagcacaccgggcgggagatcgtggacctcatgtgccacgcgacgttcaccatgcgcctgctgagcccggtgcgggtccccaactacaacctcatcatcatggacgaggcccacttcaccgaccccgcctccatcgccgcccgcggctacatcagcacccgggtggggatgggcgaggcggccgccatcttcatgacggccacgccgcccggcaccgcggaggccttcccccagtccaacgcccccatccaggacgaggagcgcgacatccccgagcgcagctggaactccgggaacgagtggatcaccgacttcgccggcaagacggtgtggttcgtccccagcatcaaggccgggaacgacatcgcgaactgcctgcggaagaacggcaagaaggtgatccagctgtcccgcaagaccttcgacaccgagtaccagaagacccggctcaacgactgggacttcgtggtcacgaccgacatcagcgagatgggggccaacttcaaggccgaccgcgtgatcgacccccggcgctgcctgaagcccgtgatcctgaccgacggccccgagcgggtcatcctcgccggcccgatgcccgtgaccgccgcgtccgccgcccagcgccgggggcgcgtgggccggaacccccagaaggagaacgaccagtacatcttcacggggcagcccctgaacaacgacgaggaccacgcccactggaccgaggccaagatgctgctcgacaacatcaacaccccggagggcatcatccccgcgctgttcgagcccgagcgcgagaagtccgccgccatcgacggggagtaccggctgaagggcgagtcccgcaagaccttcgtcgagctcatgcggcgcggcgacctgcccgtgtggctggcccacaaggtggcgagcgaggggatcaagtacaccgaccggaagtggtgcttcgacggcgagcgcaacaaccagatcctcgaggagaacatggacgtcgagatctggacgaaggagggggagcggaagaagctgcgcccgcgctggctggacgcccggacctactccgaccccctcgccctgaaggagttcaaggacttcgccgccggccgcaagagcatcgcgctggacctcgtgaccgagatcggccgggtcccctcccacctggcccaccgcacccggaacgccctggacaacctcgtgatgctgcacacgagcgagcacgggggccgcgcctaccggcacgccgtggaggagctgccggagaccatggagaccctcctgctgctcgggctgatgatcctgctcaccggcggggcgatgctgttcctgatcagcggcaagggcatcgggaagacgtccatcggcctcatctgcgtcatcgtgagctccgggatgctgtggatggccgacgtgcccctgcagtggatcgccagcgccatcgtcctcgagttcttcatgatggtgctgctgatccccgagcccgagaagcagcgcaccccgcaggacaaccagctcgcctacgtggtcatcggcatcctgaccctggcggccatcgtgaccgccaacgagatggggctcctggagacgaccaagcgggacctgggcatgtccaaggagcccggcgtggtcagccccacctcctacctcgacgtggacctgcaccccgccagcgcctggaccctgtacgcggtggccacgaccgtcatcaccccgatgctccgccacaccatcgagaactccacggccaacgtgagcctggccgcgatcgccaaccaggccgtggtcctgatggggctcgacaagggctggcccatctccaagatggacctgggggtgcccctgctcgccctgggctgctacagccaggtgaaccccctgaccctcaccgccgcggtcctgctgctcgtgacccactacgccatcatcgggccgggcctgcaggccaaggccacgcgggaggcccagaagcgcaccgcggccggcatcatgaagaaccccaccgtggacgggatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgcgaccgggcccatcaccacgctgtgggagggctccccgggcaagttctggaacaccaccatcgccgtgagcatggccaacatcttccgcgggtcctacctggccggcgcggggctcgccttcagcatcatgaagtccgtgggcaccgggaagcggggcacgggcagccagggggagaccctgggcgagaagtggaagaagaagctgaaccagctcagccgcaaggagttcgacctgtacaagaagtccgggatcaccgaggtcgaccggaccgaggccaaggagggcctgaagcgcggggagaccacgcaccacgccgtgagccggggctccgccaagctccagtggttcgtggagcgcaacatggtcatccccgagggccgggtgatcgacctggggtgcggccgcgggggctggagctactactgcgcggggctgaagaaggtgaccgaggtccgcggctacaccaagggcgggcccggccacgaggagcccgtgccgatgtccacctacgggtggaacatcgtgaagctcatgagcggcaaggacgtcttctacctgccgcccgagaagtgcgacacgctgctgtgcgacatcggggagtccagcccctccccgaccgtggaggagagccggaccatccgcgtgctcaagatggtcgagccctggctgaagaacaaccagttctgcatcaaggtgctgaacccctacatgcccaccgtgatcgagcacctcgagcggctgcagcgcaagcacggcggcatgctggtccggaacccgctctcccgcaacagcacgcacgagatgtactggatctccaacgggaccggcaacatcgtgagctccgtgaacatggtcagccggctgctgctcaaccgcttcaccatgacccaccggcgccccacgatcgagaaggacgtggacctgggggccggcacccggcacgtgaacgccgagcccgagaccccgaacatggacgtcatcggcgagcgcatcaagcggatcaaggaggagcactccagcacctggcactacgacgacgagaacccctacaagacgtgggcctaccacgggtcctacgaggtgaaggccaccggcagcgcgagctccatgatcaacggggtcgtgaagctgctcaccaagccctgggacgtggtccccatggtgacccagatggccatgacggacaccaccccgttcggccagcagcgcgtgttcaaggagaaggtcgacacccggacgccccgccccatgcccgggacccggaaggtgatggagatcaccgccgagtggctgtggcgcaccctgggccggaacaagcgcccgcgcctctgcacgcgggaggagttcaccaagaaggtgcgcaccaacgccgccatgggcgcggtcttcaccgaggagaaccagtgggacagcgcccgggccgccgtggaggacgaggagttctggaagctggtggaccgcgagcgggagctgcacaagctcgggaagtgcggctcctgcgtctacaacatgatggggaagcgcgagaagaagctgggcgagttcgggaaggcgaagggcagccgggccatctggtacatgtggctgggcgcccgctacctcgagttcgaggccctggggttcctgaacgaggaccactggttctcccgggagaacagctactccggcgtggagggggagggcctccacaagctggggtacatcctgcgcgacatcagcaagatccccggcggcgccatgtacgcggacgacacggccgggtgggacacccggatcaccgaggacgacctccacaacgaggagaagatcacccagcagatggaccccgagcaccgccagctggccaacgccatcttcaagctgacgtaccagaacaaggtggtcaaggtgcagcggcccaccccgaagggcaccgtgatggacatcatctcccgcaaggaccagcgggggagcggccaggtcggcacctacgggctcaacaccttcacgaacatggaggcccagctggtgcgccagatggagggcgagggggtgctgtccaaggtcgacctcgagaacccccacctcctggagaagaagatcacccagtggctcgagaccaagggcgtggagcggctgcgccggatggcgatcagcggggacgactgcgtggtcaagcccatcgacgaccgcttcgccaacgccctgctcgccctgaacgacatgggcaaggtgcggaaggacatcccccagtggcagccgtccaagggctggcacgactggcagcaggtccccttctgcagccaccacttccacgagctgatcatgaaggacgggcgcaagctcgtcgtgccctgccgcccccaggacgagctgatcggccgggcccgcatctcccagggggcgggctggagcctgaaggagaccgcctgcctcgggaaggcctacgcccagatgtggtccctgatgtacttccaccggcgcgacctgcggctcgccagcaacgcgatctgctccgccgtgccggtccactgggtgcccacgagccgcaccacctggagcatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcggctccctcatcgggctgaccagccgggccacctgggcgcagaacatcctgaccgccatccagcaggtccgctccctcatcggcgacgaggagttcctggactacatgcccagcatgaagcggttccgcaaggaggaggagtccgagggggccatctggtga

SEQ ID NO: 10119 - RNA, 9873 nt, synthetic construct
  misc_feature 1..9873: note = derived and/or modified CDS sequence (opt1) from DENV-3__FJ810414__SS-prME
  source 1..9873: mol_type = other RNA
accagcctgtgcctcatgatgatgctgcccgccaccctggccttccacctcaccagccgggacggcgagccgcggatgatcgtggccaagaacgagcgcggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccgcacccagacctggatgagcgccgagggggcctggcggcaggtcgagaaggtggagacgtgggcgctccgccacccgggcttcaccatcctggccctgttcctcgcccactacatcgggacctccctgacccagaaggtggtgatcttcatcctgctcatgctggtgacgcccagcatgaccatgcggtgcgtgggcgtggggaaccgcgacttcgtcgagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcgagcccatcgagggcaaggtggtccagcacgagaacctgaagtacaccgtgatcatcacggtgcacaccggcgaccagcaccaggtcgggaacgacacccagggcgtgaccgtcgagatcacgccccaggccagcaccgtggaggcgatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcggctcccaggagggggcgatgcacaccgccctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtgtccgagacccagcacggcacgatcctgatcaaggtcgagtacaagggggaggacgcgccgtgcaagatccccttcagcaccgaggacggccaggggaaggcccacaacggccgcctgatcaccgccaaccccgtggtgaccaagaaggaggagcccgtcaacatcgaggccgagccgcccttcggcgagagcaacatcgtgatcgggatcggcgacaaggcgctcaagatcaactggtacaagaaggggtccagcatcggcaagatgttcgaggccacggcccgcggggcccgccggatggccatcctgggcgacaccgcgtgggacttcggctccgtcggcggggtcctgaacagcctcgggaagatggtgcaccagatcttcgggtccgcctacaccgccctgttcagcggggtgtcctggatcatgaagatcggcatcggcgtcctgctcacctggatcgggctgaacagcaagaacacgtccatgagcttctcctgcatcgtgatcggcatcatcaccctgtacctcggggccgtggtccaggccgacatgggctgcgtgatcaactggaaggggaaggagctgaagtgcggcagcggcatcttcgtgaccaacgaggtccacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtggtcgtgggcgacatcatcggggtgctggagcagggcaagcgcaccctcacgccccagccgatggagctgaagtactcctggaagacctggggcaaggccaagatcgtcacggccgagacccagaacagctccttcatcatcgacgggcccaacacccccgagtgccccagcgcctcccgggcgtggaacgtgtgggaggtggaggactacggcttcggggtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacggcagctggaagctggagaaggcgtccttcatcgaggtcaagacctgcacctggcccaagagccacaccctctggtccaacggggtgctggagagcgacatgatcatccccaagtccctggccggccccatcagccagcacaaccaccggccggggtaccacacgcagaccgccggcccctggcacctcgggaagctggagctggacttcaactactgcgagggcaccaccgtggtcatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggccaagagcctggtgtccgccggcagcggcaagatggacaacttcaccatggggatcctgtgcctcgcgatcctgttcgaggaggtcatgcggggcaagttcgggaagaagcacatgatcgccggcgtgctgttcaccttcgtgctcctgctgtccgggcagatcacgtggcgcgacatggcccacaccctcatcatgatcggcagcaacgcctccgaccggatgggcatgggggtcacctacctggccctgatcgcgaccttcaagatccagcccttcctcgccctgggcttcttcctgcgcaagctcacgagccgggagaacctgctgctcggggtgggcctggccatggccaccaccctgcagctccccgaggacatcgagcagatggcgaacggcatcgccctggggctgatgaccctcaagctgatcacgcagttcgagacctaccagctgtggaccgccctcgtgagcctgacctgctccaacacgatcttcaccctgaccgtcgcctggcgcaccgccacgctcatcctggcgggcgtgagcctgctcccgctgtgccagtccagctccatgcggaagaccgactggctgcccatgaccgtggccgccatgggggtgccgcccctgccgctgttcatcttcagcctgaaggacacccccaagcgccgctcctggcccctcaacgagggcgtgatggccgtcgggctggtgagcatcctggcctccagcctcctgcggaacgacgtgcccatggcgggcccgctggtcgccggcgggctcctgatcgcctgctacgtgatcacgggcacctccgccgacctgaccgtggagaaggccgcggacgtcacctgggaggaggaggccgagcagacgggggtgagccacaacctcatgatcaccgtggacgacgacggcaccatgcgcatcaaggacgacgagaccgagaacatcctgaccgtcctgctcaagacggccctgctgatcgtgtccgggatcttcccctacagcatccccgccaccctcctggtgtggcacacctggcagaagcagacccagcggtccggcgtcctgtgggacgtgcccagcccgcccgagacgcagaaggccgagctcgaggagggcgtgtaccgcatcaagcagcaggggatcttcggcaagacccaggtcggggtgggcgtgcagaaggagggggtcttccacaccatgtggcacgtgacccggggcgcggtgctgacgcacaacggcaagcgcctggagcccaactgggcctccgtcaagaaggacctcatcagctacgggggcgggtggcggctgtccgcccagtggcagaagggcgaggaggtccaggtgatcgccgtcgagcccgggaagaacccgaagaacttccagaccatgcccggcatcttccagaccaccacgggcgagatcggggcgatcgccctggacttcaagcccggcaccagcgggagcccgatcatcaaccgcgagggcaaggtggtgggcctgtacgggaacggcgtcgtgaccaagaacgggggctacgtgtccgggatcgcccagaccaacgccgagcccgacggccccacgcccgagctcgaggaggagatgttcaagaagcggaacctgaccatcatggacctgcacccgggcagcgggaagacccgcaagtacctccccgccatcgtccgggaggcgatcaagcgccggctgcgcaccctgatcctcgcccccacgcgggtggtggccgccgagatggaggaggccctgaagggcctgcccatccgctaccagaccaccgcgatcaagtccgagcacaccgggcgggagatcgtcgacctcatgtgccacgccacgttcaccatgcgcctgctgagcccggtgcgggtgcccaactacaacctcatcatcatggacgaggcccacttcaccgaccccgcctccatcgccgcgcgcggctacatcagcacccgggtcgggatgggcgaggccgccgccatcttcatgacggcgacgccgcccggcaccgccgaggccttcccccagtccaacgcccccatccaggacgaggagcgcgacatccccgagcgcagctggaactccgggaacgagtggatcaccgacttcgtgggcaagacggtgtggttcgtccccagcatcaaggccgggaacgacatcgcgaactgcctgcggaagaacggcaagaaggtgatccagctgtcccgcaagaccttcgacaccgagtaccagaagacccggctcaacgactgggacttcgtggtcacgaccgacatcagcgagatgggggccaacttcaaggccgaccgcgtgatcgacccccggcgctgcctgaagcccgtgatcctgaccgacggccccgagcgggtcatcctcgccggcccgatgcccgtgaccgccgcgtccgccgcccagcgccgggggcgcgtgggccggaacccccagaaggagaacgaccagtacatcttcacggggcagcccctgaacaacgacgaggaccacgcccactggaccgaggccaagatgctgctcgacaacatcaacaccccggagggcatcatccccgcgctgttcgagcccgagcgcgagaagtccgccgccatcgacggggagtaccggctgaagggcgagtcccgcaagaccttcgtcgagctcatgcggcgcggcgacctgcccgtgtggctggcccacaaggtggcgagcgaggggatcaagtacaccgaccggaagtggtgcttcgacggcgagcgcaacaaccagatcctcgaggagaacatggacgtcgagatctggacgaaggagggggagcggaagaagctgcgcccgcgctggctggacgcccggacctactccgaccccctcgccctgaaggagttcaaggacttcgccgccggccgcaagagcatcgcgctggacctcgtgaccgagatcggccgggtcccctcccacctggcccaccgcacccggaacgccctggacaacctcgtgatgctgcacacgagcgagcacgggggccgcgcctaccggcacgccgtggaggagctgccggagaccatggagaccctcctgctgctcgggctgatgatcctgctcaccggcggggcgatgctgttcctgatcagcggcaagggcatcgggaagacgtccatcggcctcatctgcgtcatcgtgagctccgggatgctgtggatggccgacgtgcccctgcagtggatcgccagcgccatcgtcctcgagttcttcatgatggtgctgctgatccccgagcccgagaagcagcgcaccccgcaggacaaccagctcgcctacgtggtcatcggcatcctgaccctggcggccatcgtgaccgccaacgagatggggctcctggagacgaccaagcgggacctgggcatgtccaaggagcccggcgtggtcagccccacctcctacctcgacgtggacctgcaccccgccagcgcctggaccctgtacgcggtggccacgaccgtcatcaccccgatgctccgccacaccatcgagaactccacggccaacgtgagcctggccgcgatcgccaaccaggccgtggtcctgatggggctcgacaagggctggcccatctccaagatggacctgggggtgcccctgctcgccctgggctgctacagccaggtgaaccccctgaccctcaccgccgcggtcctgctgctcgtgacccactacgccatcatcgggccgggcctgcaggccaaggccacgcgggaggcccagaagcgcaccgcggccggcatcatgaagaaccccaccgtggacgggatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgcgaccgggcccatcaccacgctgtgggagggctccccgggcaagttctggaacaccaccatcgccgtgagcatggccaacatcttccgcgggtcctacctggccggcgcggggctcgccttcagcatcatgaagtccgtgggcaccgggaagcggggcacgggcagccagggggagaccctgggcgagaagtggaagaagaagctgaaccagctcagccgcaaggagttcgacctgtacaagaagtccgggatcaccgaggtcgaccggaccgaggccaaggagggcctgaagcgcggggagaccacgcaccacgccgtgagccggggctccgccaagctccagtggttcgtggagcgcaacatggtcatccccgagggccgggtgatcgacctggggtgcggccgcgggggctggagctactactgcgcggggctgaagaaggtgaccgaggtccgcggctacaccaagggcgggcccggccacgaggagcccgtgccgatgtccacctacgggtggaacatcgtgaagctcatgagcggcaaggacgtcttctacctgccgcccgagaagtgcgacacgctgctgtgcgacatcggggagtccagcccctccccgaccgtggaggagagccggaccatccgcgtgctcaagatggtcgagccctggctgaagaacaaccagttctgcatcaaggtgctgaacccctacatgcccaccgtgatcgagcacctcgagcggctgcagcgcaagcacggcggcatgctggtccggaacccgctctcccgcaacagcacgcacgagatgtactggatctccaacgggaccggcaacatcgtgagctccgtgaacatggtcagccggctgctgctcaaccgcttcaccatgacccaccggcgccccacgatcgagaaggacgtggacctgggggccggcacccggcacgtgaacgccgagcccgagaccccgaacatggacgtcatcggcgagcgcatcaagcggatcaaggaggagcactccagcacctggcactacgacgacgagaacccctacaagacgtgggcctaccacgggtcctacgaggtgaaggccaccggcagcgcgagctccatgatcaacggggtcgtgaagctgctcaccaagccctgggacgtggtccccatggtgacccagatggccatgacggacaccaccccgttcggccagcagcgcgtgttcaaggagaaggtcgacacccggacgccccgccccatgcccgggacccggaaggtgatggagatcaccgccgagtggctgtggcgcaccctgggccggaacaagcgcccgcgcctctgcacgcgggaggagttcaccaagaaggtgcgcaccaacgccgccatgggcgcggtcttcaccgaggagaaccagtgggacagcgcccgggccgccgtggaggacgaggagttctggaagctggtggaccgcgagcgggagctgcacaagctcgggaagtgcggctcctgcgtctacaacatgatggggaagcgcgagaagaagctgggcgagttcgggaaggcgaagggcagccgggccatctggtacatgtggctgggcgcccgctacctcgagttcgaggccctggggttcctgaacgaggaccactggttctcccgggagaacagctactccggcgtggagggggagggcctccacaagctggggtacatcctgcgcgacatcagcaagatccccggcggcgccatgtacgcggacgacacggccgggtgggacacccggatcaccgaggacgacctccacaacgaggagaagatcacccagcagatggaccccgagcaccgccagctggccaacgccatcttcaagctgacgtaccagaacaaggtggtcaaggtgcagcggcccaccccgaagggcaccgtgatggacatcatctcccgcaaggaccagcgggggagcggccaggtcggcacctacgggctcaacaccttcacgaacatggaggcccagctggtgcgccagatggagggcgagggggtgctgtccaaggtcgacctcgagaacccccacctcctggagaagaagatcacccagtggctcgagaccaagggcgtggagcggctgcgccggatggcgatcagcggggacgactgcgtggtcaagcccatcgacgaccgcttcgccaacgccctgctcgccctgaacgacatgggcaaggtgcggaaggacatcccccagtggcagccgtccaagggctggcacgactggcagcaggtccccttctgcagccaccacttccacgagctgatcatgaaggacgggcgcaagctcgtcgtgccctgccgcccccaggacgagctgatcggccgggcccgcatctcccagggggcgggctggagcctgaaggagaccgcctgcctcgggaaggcctacgcccagatgtggtccctgatgtacttccaccggcgcgacctgcggctcgccagcaacgcgatctgctccgccgtgccggtccactgggtgcccacgagccgcaccacctggagcatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcggctccctcatcgggctgaccagccgggccacctgggcgcagaacatcctgaccgccatccagcaggtccgctccctcatcggcgacgaggagttcctggactacatgcccagcatgaagcggttccgcaaggaggaggagtccgagggggccatctggtga

SEQ ID NO: 10120 - RNA, 9873 nt, synthetic construct
  misc_feature 1..9873: note = derived and/or modified CDS sequence (opt1) from DENV-3__FJ744734__SS-prME
  source 1..9873: mol_type = other RNA
accagcctgtgcctcatgatgatgctgcccgccaccctggccttccacctcaccagccgggacggcgagccccggatgatcgtggccaagaacgagcgcggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccgcacccagacctggatgagcgccgagggggcctggcgccaggtggagaaggtggagacgtgggcgctccgccacccgggcttcaccatcctggccctgttcctcgcccactacatcgggacctccctgacccagaaggtggtgatcttcatcctgctcatgctggtgacgcccagcatgaccatgcggtgcgtgggcgtggggaaccgcgacttcgtcgagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcgagcccatcgagggcaaggtggtccagcacgagaacctgaagtacaccgtgatcatcacggtgcacaccggcgaccagcaccaggtcgggaacgacacccagggcgtgaccgtcgagatcacgccccaggccagcaccgtggaggcgatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcggctcccaggagggggcgatgcacaccgccctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtgtccgagacccagcacggcacgatcctgatcaaggtcgagtacaagggggaggacgcgccgtgcaagatccccttcagcaccgaggacggccaggggaaggcccacaacggccgcctgatcaccgccaaccccgtggtgaccaagaaggaggagcccgtcaacatcgaggccgagccgcccttcggcgagagcaacatcgtgatcgggatcggcgacaaggcgctcaagatcaactggtacaagaaggggtccagcatcggcaagatgttcgaggccacggcccgcggggcccgccggatggccatcctgggcgacaccgcgtgggacttcggctccgtcggcggggtcctgaacagcctcgggaagatggtgcaccagatcttcgggtccgcctacaccgccctgttcagcggggtgtcctggatcatgaagatcggcatcggcgtcctgctcacctggatcgggctgaacagcaagaacacgtccatgagcttctcctgcatcgtgatcggcatcatcaccctgtacctcggggccgtggtccaggccgacatgggctgcgtgatcaactggaaggggaaggagctgaagtgcggcagcggcatcttcgtgaccaacgaggtccacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtggtcgtgggcgacatcatcggggtgctggagcagggcaagcgcaccctcacgccccagccgatggagctgaagtactcctggaagacctggggcaaggccaagatcgtcacggccgagacccagaacagctccttcatcatcgacgggcccaacacccccgagtgccccagcgcctcccgggcgtggaacgtgtgggaggtggaggactacggcttcggggtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacggcagctggaagctggagaaggcgtccttcatcgaggtcaagacctgcacctggcccaagagccacaccctctggtccaacggggtgctggagagcgacatgatcatccccaagtccctggccggccccatcagccagcacaaccaccggccggggtaccacacgcagaccgccggcccctggcacctcgggaagctggagctggacttcaactactgcgagggcaccaccgtggtcatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggtcaagagcctggtctccgccggcagcggcaagatggacaacttcaccatggggatcctgtgcctcgccatcctgttcgaggaggtgatgcggggcaagttcgggaagaagcacatgatcgcgggcgtgctgttcaccttcgtcctcctgctgtccgggcagatcacgtggcgcgacatggcccacaccctcatcatgatcggcagcaacgcctccgaccggatgggcatgggggtgacctacctggccctgatcgccaccttcaagatccagcccttcctcgcgctgggcttcttcctgcgcaagctcacgagccgggagaacctgctgctcggggtgggcctggccatggccaccaccctgcagctccccgaggacatcgagcagatggccaacggcatcgcgctggggctgatgaccctcaagctgatcacgcagttcgagacctaccagctgtggaccgccctcgtcagcctgacctgctccaacacgatcttcaccctgaccgtggcctggcgcaccgccacgctcatcctggccggcgtgagcctgctcccgctgtgccagtccagctccatgcggaagaccgactggctgcccatgaccgtcgcggccatgggggtgccgcccctgccgctgttcatcttcagcctgaaggacacccccaagcgccgctcctggcccctcaacgagggcgtcatggccgtggggctggtgagcatcctggcctccagcctcctgcggaacgacgtccccatggccggcccgctggtggcgggcgggctcctgatcgcctgctacgtgatcacgggcacctccgccgacctgaccgtcgagaaggccgccgacgtgacctgggaggaggaggcggagcagacgggggtgagccacaacctcatgatcaccgtcgacgacgacggcaccatgcgcatcaaggacgacgagaccgagaacatcctgaccgtgctgctcaagacggccctgctgatcgtgtccgggatcttcccctacagcatccccgccaccctcctggtctggcacacctggcagaagcagacccagcggtccggcgtgctgtgggacgtgcccagcccgcccgagacgcagaaggccgagctcgaggagggcgtctaccgcatcaagcagcaggggatcttcggcaagacccaggtgggggtgggcgtccagaaggagggggtgttccacaccatgtggcacgtgacccggggcgccgtcctgacgcacaacggcaagcgcctggagcccaactgggcgtccgtgaagaaggacctcatcagctacgggggcgggtggcggctgtccgcccagtggcagaagggcgaggaggtgcaggtcatcgccgtggagcccgggaagaacccgaagaacttccagaccatgcccggcatcttccagaccaccatgggcgagatcggggccatcgcgctggacttcaagcccggcacgagcgggagcccgatcatcaaccgcgagggcaaggtggtcggcctgtacgggaacggcgtggtgaccaagaacgggggctacgtctccgggatcgcccagaccaacgccgagcccgacggccccacccccgagctcgaggaggagatgttcaagaagcggaacctgacgatcatggacctgcacccgggcagcgggaagacccgcaagtacctccccgccatcgtgcgggaggccatcaagcgccggctgcgcaccctgatcctcgcgcccacccgggtggtcgccgccgagatggaggaggccctgaagggcctgcccatccgctaccagacgaccgccatcaagtccgagcacaccgggcgggagatcgtggacctcatgtgccacgcgaccttcacgatgcgcctgctgagcccggtgcgggtccccaactacaacctcatcatcatggacgaggcccacttcaccgaccccgcctccatcgccgcccgcggctacatcagcacccgggtggggatgggcgaggcggccgccatcttcatgaccgccacgcccccgggcaccgcggaggccttcccccagtccaacgcccccatccaggacgaggagcgcgacatccccgagcgcagctggaactccgggaacgagtggatcaccgacttcgtgggcaagaccgtctggttcgtgccgagcatcaaggccgggaacgacatcgccaactgcctgcggaagaacggcaagaaggtgatccagctgtcccgcaagacgttcgacaccgagtaccagaagacccggctcaacgactgggacttcgtcgtgaccacggacatcagcgagatgggggcgaacttcaaggccgaccgcgtgatcgacccccggcgctgcctgaagcccgtcatcctgaccgacggccccgagcgggtgatcctcgccggcccgatgcccgtgaccgccgcctccgcggcccagcgccgggggcgcgtcggccggaacccccagaaggagaacgaccagtacatcttcaccgggcagcccctgaacaacgacgaggaccacgcccactggacggaggccaagatgctgctcgacaacatcaacaccccggagggcatcatccccgccctgttcgagcccgagcgcgagaagtccgcggccatcgacggggagtaccggctgaagggcgagtcccgcaagaccttcgtggagctcatgcggcgcggcgacctgcccgtgtggctggcccacaaggtcgccagcgaggggatcaagtacaccgaccggaagtggtgcttcgacggcgagcgcaacaaccagatcctcgaggagaacatggacgtggagatctggaccaaggagggggagcggaagaagctgcgcccgcgctggctggacgcgcggacgtactccgaccccctcgccctgaaggagttcaaggacttcgccgccggccgcaagagcatcgccctggacctcgtcaccgagatcggccgggtgccctcccacctggcgcaccgcacccggaacgccctggacaacctcgtgatgctgcacaccagcgagcacgggggccgcgcctaccggcacgccgtcgaggagctgccggagacgatggagaccctcctgctgctcgggctgatgatcctgctcaccggcggggccatgctgttcctgatcagcggcaagggcatcgggaagacctccatcggcctcatctgcgtgatcgtgagctccgggatgctgtggatggcggacgtccccctgcagtggatcgccagcgccatcgtgctcgagttcttcatgatggtgctgctgatccccgagcccgagaagcagcgcacgccgcaggacaaccagctcgcctacgtcgtgatcggcatcctgaccctggccgcgatcgtgaccgccaacgagatggggctcctggagaccacgaagcgggacctgggcatgtccaaggagcccggcgtcgtgagccccacctcctacctcgacgtggacctgcaccccgccagcgcctggaccctgtacgccgtcgcgaccacggtgatcaccccgatgctccgccacaccatcgagaactccaccgccaacgtgagcctggccgccatcgcgaaccaggccgtcgtgctgatggggctcgacaagggctggcccatctccaagatggacctgggggtgcccctgctcgccctgggctgctacagccaggtcaaccccctgacgctcaccgccgccgtgctgctgctcgtgacccactacgcgatcatcgggccgggcctgcaggccaaggccacccgggaggcccagaagcgcacggccgcgggcatcatgaagaaccccaccgtcgacgggatcatgaccatcgacctggaccccgtgatctacgactccaagttcgagaagcagctcggccaggtgatgctgctggtcctctgcgccgtgcagctgctgctcatgcggaccagctgggccctgtgcgaggccctgacgctcgccaccgggcccatcaccaccctgtgggagggctccccgggcaagttctggaacacgaccatcgcggtgagcatggccaacatcttccgcgggtcctacctggccggcgccgggctcgcgttcagcatcatgaagtccgtcggcaccgggaagcggggcaccggcagccagggggagacgctgggcgagaagtggaagaagaagctgaaccagctcagccgcaaggagttcgacctgtacaagaagtccgggatcaccgaggtggaccggaccgaggccaaggagggcctgaagcgcggggagaccacccaccacgccgtgagccggggctccgccaagctccagtggttcgtcgagcgcaacatggtgatccccgagggccgggtgatcgacctggggtgcggccgcgggggctggagctactactgcgccgggctgaagaaggtcacggaggtgcgcggctacaccaagggcgggcccggccacgaggagcccgtgccgatgtccacctacgggtggaacatcgtcaagctcatgagcggcaaggacgtgttctacctgccgcccgagaagtgcgacaccctgctgtgcgacatcggggagtccagcccctccccgacggtggaggagagccggaccatccgcgtcctcaagatggtggagccctggctgaagaacaaccagttctgcatcaaggtgctgaacccctacatgcccaccgtcatcgagcacctcgagcggctgcagcgcaagcacggcggcatgctggtgcggaacccgctctcccgcaacagcacccacgagatgtactggatctccaacgggacgggcaacatcgtgagctccgtcaacatggtgagccggctgctgctcaaccgcttcaccatgacccaccggcgccccaccatcgagaaggacgtggacctgggggcgggcacgcggcacgtcaacgccgagcccgagaccccgaacatggacgtgatcggcgagcgcatcaagcggatcaaggaggagcactccagcacctggcactacgacgacgagaacccctacaagacctgggcctaccacgggtcctacgaggtcaaggccacgggcagcgccagctccatgatcaacggggtggtgaagctgctcaccaagccctgggacgtcgtgcccatggtgacccagatggcgatgaccgacacgaccccgttcggccagcagcgcgtcttcaaggagaaggtggacacccggacgccccggcccatgcccgggacgcggaaggtgatggagatcaccgccgagtggctgtggcgcaccctgggccggaacaagcgcccgcgcctctgcacccgggaggagttcacgaagaaggtccgcaccaacgccgccatgggcgccgtgttcaccgaggagaaccagtgggacagcgcgcgggccgccgtggaggacgaggagttctggaagctggtcgaccgcgagcgggagctgcacaagctcgggaagtgcggctcctgcgtgtacaacatgatggggaagcgcgagaagaagctgggcgagttcgggaaggccaagggcagccgggcgatctggtacatgtggctgggcgcccgctacctcgagttcgaggccctggggttcctgaacgaggaccactggttctcccgggagaacagctactccggcgtggagggggagggcctccacaagctggggtacatcctgcgcgacatcagcaagatccccggcggcgccatgtacgccgacgacaccgcggggtgggacacgcggatcaccgaggacgacctccacaacgaggagaagatcacccagcagatggaccccgagcaccgccagctggccaacgccatcttcaagctgacctaccagaacaaggtcgtgaaggtgcagcggcccacgccgaagggcaccgtcatggacatcatctcccgcaaggaccagcgggggagcggccaggtgggcacctacgggctcaacaccttcaccaacatggaggcccagctggtgcgccagatggagggcgagggggtcctgtccaaggtggacctcgagaacccccacctcctggagaagaagatcacgcagtggctcgagaccaagggcgtggagcggctgcgccggatggccatcagcggggacgactgcgtcgtgaagcccatcgacgaccgcttcgcgaacgccctgctcgccctgaacgacatgggcaaggtgcggaaggacatcccccagtggcagccgtccaagggctggcacgactggcagcaggtccccttctgcagccaccacttccacgagctgatcatgaaggacgggcgcaagctcgtggtgccctgccgcccccaggacgagctgatcggccgggcccgcatctcccagggggccggctggagcctgaaggagaccgcgtgcctcgggaaggcctacgcccagatgtggtccctgatgtacttccaccggcgcgacctgcggctcgccagcaacgccatctgctccgcggtcccggtgcactgggtgcccaccagccgcacgacctggagcatccacgcccaccaccagtggatgaccaccgaggacatgctgacggtctggaaccgggtgtggatcgaggacaacccctggatggaggacaagacccccgtgaccacctgggaggacgtcccgtacctgggcaagcgcgaggaccagtggtgcggctccctcatcgggctgacgagccgggccacctgggcccagaacatcctgaccgcgatccagcaggtccgctccctcatcggcgacgaggagttcctggactacatgcccagcatgaagcggttccgcaaggaggaggagtccgagggggccatctggtga

SEQ ID NO: 10121 - RNA, 9873 nt, synthetic construct
  misc_feature 1..9873: note = derived and/or modified CDS sequence (opt1) from DENV-3__FJ744737__SS-prME
  source 1..9873: mol_type = other RNA
accagcctgtgcctcatgatgatgctgcccgccaccctggccttccacctcaccagccgggacggcgagccgcggatgatcgtggccaagaacgagcgcggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccgcacccagacctggatgagcgccgagggggcctggcggcaggtcgagaaggtggagacgtgggcgctccgccacccgggcttcaccatcctggccctgttcctcgcccactacatcgggacctccctgacccagaaggtggtgatcttcatcctgctcatgctggtgacgcccagcatgaccatgcggtgcgtgggcgtggggaaccgcgacttcgtggagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcgagcccatcgagggcaaggtggtccagcacgagaacctgaagtacaccgtgatcatcacggtgcacaccggcgaccagcaccaggtcgggaacgacacccagggcgtgaccgccgagatcacgccccaggcgagcaccgtcgaggccatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtgaccttcaagaacgcccacgcgaagaagcaggaggtcgtggtgctcggctcccaggagggggccatgcacaccgccctgaccggcgccacggagatccagaacagcgggggcacctccatcttcgccgggcacctgaagtgccggctcaagatggacaagctggagctgaagggcatgagctacgcgatgtgcctcaacaccttcgtcctgaagaaggaggtgtccgagacccagcacggcacgatcctgatcaaggtggagtacaagggggaggacgccccgtgcaagatccccttcagcaccgaggacggccaggggaaggcccacaacggccgcctgatcaccgccaaccccgtcgtgaccaagaaggaggagcccgtgaacatcgaggcggagccgcccttcggcgagagcaacatcgtcatcgggatcggcgacaaggccctcaagatcaactggtacaagaaggggtccagcatcggcaagatgttcgaggccacggcccgcggggcccgccggatggcgatcctgggcgacaccgcctgggacttcggctccgtcggcggggtgctgaacagcctcgggaagatggtccaccagatcttcgggtccgcctacaccgccctgttcagcggggtgtcctggatcatgaagatcggcatcggcgtgctgctcacctggatcgggctgaacagcaagaacacgtccatgagcttctcctgcatcgtcatcggcatcatcaccctgtacctcggggccgtggtgcaggcggacatgggctgcgtcatcaactggaaggggaaggagctgaagtgcggcagcggcatcttcgtgaccaacgaggtgcacacctggacggagcagtacaagttccaggccgactcccccaagcgcctggccaccgccatcgccggggcgtgggagaacggcgtctgcgggatccgcagcaccacccggatggagaacctcctgtggaagcagatcgccaacgagctgaactacatcctctgggagaacaacatcaagctgacggtggtggtcggcgacatcatcggggtgctggagcagggcaagcgcaccctcacgccccagccgatggagctgaagtactcctggaagacctggggcaaggccaagatcgtgacggccgagacccagaacagctccttcatcatcgacgggcccaacacccccgagtgccccagcgcgtcccgggcctggaacgtctgggaggtggaggactacggcttcggggtgttcaccacgaacatctggctgaagctccgcgaggtctacacccagagctgcgaccaccggctgatgagcgccgccatcaaggacgagcgcgccgtgcacgcggacatgggctactggatcgagtcccagaagaacggcagctggaagctggagaaggcctccttcatcgaggtgaagacctgcacctggcccaagagccacaccctctggtccaacggggtcctggagagcgacatgatcatccccaagtccctggccggccccatcagccagcacaaccaccggccggggtaccacacgcagaccgccggcccctggcacctcgggaagctggagctggacttcaactactgcgagggcaccaccgtggtgatcacggagaactgcggcacccgcgggccctccctccggaccaccacggtcagcggcaagctgatccacgagtggtgctgccgctcctgcaccctgcccccgctccggtacatgggggaggacggctgctggtacgggatggagatccgccccatcaacgagaaggaggagaacatggtcaagagcctggtgtccgccggcagcggcaagatggacaacttcaccatggggatcctgtgcctcgcgatcctgttcgaggaggtcatgcggggcaagttcgggaagaagcacatgatcgccggcgtgctgttcaccttcgtgctcctgctgtccgggcagatcacgtggcgcgacatggcccacaccctcatcatgatcggcagcaacgcctccgaccggatgggcatgggggtcacctacctggccctgatcgcgaccttcaagatccagcccttcctcgccctgggcttcttcctgcgcaagctcacgagccgggagaacctgctgctcggggtgggcctggccatggccaccaccctgcagctccccgaggacatcgagcagatggcgaacggcatcgccctggggctgatgaccctcaagctgatcacgcagttcgagacctaccagctgtggaccgccctcgtgagcctgacctgctccaacacgatcttcaccctgaccgtcgcctggcgcaccgccacgctcatcctggcgggcgtgagcctgctcccgctgtgccagtccagctccatgcggaagaccgactggctgcccatgaccgtggccgccatgggggtgccgcccctgccgctgttcatcttcagcctgaaggacacccccaagcgccgctcctggcccctcaacgagggcgtgatggccgtcgggctggtgagcatcctggcctccagcctcctgcggaacgacgtgcccatggcgggcccgctggtcgccggcgggctcctgatcgcctgctacgtgatcacgggcacctccgccgacctgaccgtggagaaggccgcggacgtcacctgggaggaggaggccgagcagacgggggtgagccacaacctcatgatcaccgtggacgacgacggcaccatgcgcatcaaggacgacgagaccgagaacatcctgaccgtcctgctcaagacggccctgctgatcgtgtccgggatcttcccctacagcatccccgccaccctcctggtgtggcacacctggcagaagcagacccagcggtccggcgtcctgtgggacgtgcccagcccgcccgagacgcagaaggccgagctcgaggagggcgtgtaccgcatcaagcagcaggggatcttcggcaagacccaggtcggggtgggcgtgcagaaggagggggtcttccacaccatgtggcacgtgacccggggcgcggtgctgacgcacaacggcaagcgcctggagcccaactgggcctccgtcaagaaggacctcatcagctacgggggcgggtggcggctgtccgcccagtggcagaagggcgaggaggtccaggtgatcgccgtcgagcccgggaagaacccgaagaacttccagaccatgcccggcatcttccagaccaccacgggcgagatcggggcgatcgccctggacttcaagcccggcaccagcgggagcccgatcatcaaccgcgagggcaaggtggtgggcctgtacgggaacggcgtcgtgaccaagaacgggggctacgtgtccgggatcgcccagaccaacgccgagcccgacggccccacgcccgagctcgaggaggagatgttcaagaagcggaacctgaccatcatggacctgcacccgggcagcgggaagacccgcaagtacctccccgccatcgtccgggaggcgatcaagcgccggctgcgcaccctgatcctcgcccccacgcgggtggtggccgccgagatggaggaggccctgaagggcctgcccatccgctaccagaccaccgcgatcaagtccgagcacaccgggcgggagatcgtcgacctcatgtgccacgccacgttcaccatgcgcctgctgagcccggtgcgggtgcccaactacaacctcatcatcatggacgaggcccacttcaccgaccccgcctccatcgccgcgcgcggctacatcagcacccgggtcgggatgggcgaggccgccgccatcttcatgacggcgacgccgcccggcaccgccgaggccttcccccagtccaacgcccccatccaggacgaggagcgcgacatccccgagcgcagctggaactccgggaacgagtggatcaccgacttcgtgggcaagacggtgtggttcgtccccagcatcaaggccgggaacgacatcgcgaactgcctgcggaagaacggcaagaaggtgatccagctgtcccgcaagaccttcgacaccgagtaccagaagacccggctcaacgactgggacttcgtggtcacgaccgacatcagcgagatgggggccaacttcaaggccgaccgcgtgatcgacccccggcgctgcctgaagcccgtgatcctgaccgacggccccgagcgggtcatcctcgccggcccgatgcccgtgaccgccgcgtccgccgcccagcgccgggggcgcgtgggccggaacccccagaaggagaacgaccagtacatcttcacggggcagcccctgaacaacgacgaggaccacgcccactggaccgaggccaagatgctgctcgacaacatcaacaccccggagggcatcatccccgcgctgttcgagcccgagcgcgagaagtccgccgccatcgacggggagtaccggctgaagggcgagtcccgcaagaccttcgtcgagctcatgcggcgcggcgacctgcccgtgtggctggcccacaaggtggcgagcgaggggatcaagtacaccgaccggaagtggtgcttcgacggcgagcgcaacaaccagatcctcgaggagaacatggacgtcgagatctggacgaaggagggggagcggaagaagctgcgcccgcgctggctggacgcccggacctactccgaccccctcgccctgaaggagttcaaggacttcgccgccggccgcaagagcatcgcgctggacctcgtgaccgagatcggccgggtcccctcccacctggcccaccgcacccggaacgccctggacaacctcgtgatgctgcacacgagcgagcacgggggccgcgcctaccggcacgccgtggaggagctgccggagaccatggagaccctcctgctgctcgggctgatgatcctgctcaccggcggggcgatgctgttcctgatcagcggcaagggcatcgggaagacgtccatcggcctcatctgcgtcatcgtgagctccgggatgctgtggatggccgacgtgcccctgcagtggatcgccagcgccatcgtcctcgagttcttcatgatggtgctgctgatccccgagcccgagaagcagcgcaccccgcaggacaaccagctcgcctacgtggtcatcggcatcctgaccctggcggccatcgtgaccgccaacgagatggggctcctggagacgaccaagcgggacctgggcatgtccaaggagcccggcgtggtcagccccacctcctacctcgacgtggacctgcaccccgccagcgcctggaccctgtacgcggtggccacgaccgtcatcaccccgatgctccgccacaccatcgagaactccacggccaacgtgagcctggccgcgatcgccaaccaggccgtggtcctgatggggctcgacaagggctggcccatctccaagatggacctgggggtgcccctgctcgccctgggctgctacagccaggtgaaccccctgaccctcaccgccgcggtcctgctgctcgtgacccactacgccatcatcgggccgggcctgcaggccaaggccacgcgggaggcccagaagcgcaccgcggccggcatcatgaagaaccccaccgtggacgggatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgcgaccgggcccatcaccacgctgtgggagggctccccgggcaagttctggaacaccaccatcgccgtgagcatggccaacatcttccgcgggtcctacctggccggcgcggggctcgccttcagcatcatgaagtccgtgggcaccgggaagcggggcacgggcagccagggggagaccctgggcgagaagtggaagaagaagctgaaccagctcagccgcaaggagttcgacctgtacaagaagtccgggatcaccgaggtcgaccggaccgaggccaaggagggcctgaagcgcggggagaccacgcaccacgccgtgagccggggctccgccaagctccagtggttcgtggagcgcaacatggtcatccccgagggccgggtgatcgacctggggtgcggccgcgggggctggagctactactgcgcggggctgaagaaggtgaccgaggtccgcggctacaccaagggcgggcccggccacgaggagcccgtgccgatgtccacctacgggtggaacatcgtgaagctcatgagcggcaaggacgtcttctacctgccgcccgagaagtgcgacacgctgctgtgcgacatcggggagtccagcccctccccgaccgtggaggagagccggaccatccgcgtgctcaagatggtcgagccctggctgaagaacaaccagttctgcatcaaggtgctgaacccctacatgcccaccgtgatcgagcacctcgagcggctgcagcgcaagcacggcggcatgctggtccggaacccgctctcccgcaacagcacgcacgagatgtactggatctccaacgggaccggcaacatcgtgagctccgtgaacatggtcagccggctgctgctcaaccgcttcaccatgacccaccggcgccccacgatcgagaaggacgtggacctgggggccggcacccggcacgtgaacgccgagcccgagaccccgaacatggacgtcatcggcgagcgcatcaagcggatcaaggaggagcactccagcacctggcactacgacgacgagaacccctacaagacgtgggcctaccacgggtcctacgaggtgaaggccaccggcagcgcgagctccatgatcaacggggtcgtgaagctgctcaccaagccctgggacgtggtccccatggtgacccagatggccatgacggacaccaccccgttcggccagcagcgcgtgttcaaggagaaggtcgacacccggacgccccgccccatgcccgggacccggaaggtgatggagatcaccgccgagtggctgtggcgcaccctgggccggaacaagcgcccgcgcctctgcacgcgggaggagttcaccaagaaggtgcgcaccaacgccgccatgggcgcggtcttcaccgaggagaaccagtgggacagcgcccgggccgccgtggaggacgaggagttctggaagctggtggaccgcgagcgggagctgcacaagctcgggaagtgcggctcctgcgtctacaacatgatggggaagcgcgagaagaagctgggcgagttcgggaaggcgaagggcagccgggccatctggtacatgtggctgggcgcccgctacctcgagttcgaggccctggggttcctgaacgaggaccactggttctcccgggagaacagctactccggcgtggagggggagggcctccacaagctggggtacatcctgcgcgacatcagcaagatccccggcggcgccatgtacgcggacgacacggccgggtgggacacccggatcaccgaggacgacctccacaacgaggagaagatcacccagcagatggaccccgagcaccgccagctggccaacgccatcttcaagctgacgtaccagaacaaggtggtcaaggtgcagcggcccaccccgaagggcaccgtgatggacatcatctcccgcaaggaccagcgggggagcggccaggtcggcacctacgggctcaacaccttcacgaacatggaggcccagctggtgcgccagatggagggcgagggggtgctgtccaaggtcgacctcgagaacccccacctcctggagaagaagatcacccagtggctcgagaccaagggcgtggagcggctgcgccggatggcgatcagcggggacgactgcgtggtcaagcccatcgacgaccgcttcgccaacgccctgctcgccctgaacgacatgggcaaggtgcggaaggacatcccccagtggcagccgtccaagggctggcacgactggcagcaggtccccttctgcagccaccacttccacgagctgatcatgaaggacgggcgcaagctcgtcgtgccctgccgcccccaggacgagctgatcggccgggcccgcatctcccagggggcgggctggagcctgaaggagaccgcctgcctcgggaaggcctacgcccagatgtggtccctgatgtacttccaccggcgcgacctgcggctcgccagcaacgcgatctgctccgccgtgccggtccactgggtgcccacgagccgcaccacctggagcatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcggctccctcatcgggctgaccagccgggccacctgggcgcagaacatcctgaccgccatccagcaggtccgctccctcatcggcgacgaggagttcctggactacatgcccagcatgaagcggttccgcaaggaggaggagtccgagggggccatctggtga

SEQ ID NO: 10122 - RNA, 9873 nt, synthetic construct
  misc_feature 1..9873: note = derived and/or modified CDS sequence (opt1) from DENV-3__FJ744739__SS-prME
  source 1..9873: mol_type = other RNA
accagcctgtgcctcatgatgatgctgcccgccaccctggccttccacctcaccagccgggacggggagccgcggatgatcgtggcgaagaacgagcgcggcaagagcctgctgttcaagaccgtgtccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtcacctacggcacgtgcaaccaggccggggagcaccggcgcgacaagcggtccgtggccctggcgccccacgtgggcatgggcctggacacccgcacccagacctggatgagcgccgagggggcctggcggcaggtcgagaaggtggagacgtgggccctccgccacccgggcttcaccatcctggcgctgttcctcgcccactacatcgggacctccctgacccagaaggtggtcatcttcatcctgctcatgctggtgacgcccagcatgaccatgcggtgcgtgggcgtcgggaaccgcgacttcgtggagggcctgtccggcgccacctgggtggacgtcgtgctcgagcacgggggctgcgtgaccacgatggccaagaacaagcccaccctggacatcgagctgcagaagaccgaggccacccagctcgcgacgctgcggaagctgtgcatcgaggggaagatcaccaacatcaccaccgacagccgctgccccacgcagggcgaggccatcctcccggaggagcaggaccagaactacgtctgcaagcacacctacgtggaccggggctgggggaacggctgcgggctgttcggcaaggggtccctggtgacctgcgccaagttccagtgcctcgagcccatcgagggcaaggtcgtgcagcacgagaacctgaagtacaccgtgatcatcacggtccacaccggcgaccagcaccaggtggggaacgacacccagggcgtcaccgtggagatcacgccccaggccagcaccgtggaggccatcctgcccgagtacgggaccctcggcctggagtgctccccgcgcaccgggctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcggctcccaggagggggccatgcacaccgcgctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtctccgagacccagcacggcacgatcctgatcaaggtggagtacaagggggaggacgccccgtgcaagatccccttcagcaccgaggacggccaggggaaggcgcacaacggccgcctgatcaccgccaaccccgtggtcaccaagaaggaggagcccgtgaacatcgaggccgagccgcccttcggcgagagcaacatcgtgatcgggatcggcgacaaggccctcaagatcaactggtacaagaaggggtccagcatcggcaagatgttcgaggcgacggcccgcggggcccgccggatggccatcctgggcgacaccgcctgggacttcggctccgtcgggggcgtgctgaacagcctcgggaagatggtgcaccagatcttcggctccgcgtacaccgccctgttcagcggggtctcctggatcatgaagatcggcatcggcgtgctgctcacctggatcgggctgaacagcaagaacacgtccatgagcttctcctgcatcgtgatcggcatcatcaccctgtacctcggggccgtcgtgcaggccgacatgggctgcgtgatcaactggaaggggaaggagctgaagtgcggcagcggcatcttcgtcaccaacgaggtgcacacctggacggagcagtacaagttccaggccgactcccccaagcgcctggcgaccgccatcgccggggcctgggagaacggcgtgtgcgggatccgcagcaccacccggatggagaacctcctgtggaagcagatcgccaacgagctgaactacatcctctgggagaacaacatcaagctgacggtcgtggtgggcgacatcatcggggtcctggagcagggcaagcgcaccctcacgccccagccgatggagctgaagtactcctggaagacctggggcaaggcgaagatcgtgacggccgagacccagaacagctccttcatcatcgacgggcccaacacccccgagtgccccagcgcctcccgggcctggaacgtgtgggaggtcgaggactacggcttcggggtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacggcagctggaagctggagaaggcctccttcatcgaggtgaagacctgcacctggcccaagagccacaccctctggtccaacggggtgctggagagcgacatgatcatccccaagtccctggcgggccccatcagccagcacaaccaccggccggggtaccacacgcagaccgccggcccctggcacctcgggaagctggagctggacttcaactactgcgagggcaccaccgtcgtgatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggtcaagagcctggtgtccgccggcagcggcaagatggacaacttcaccatggggatcctgtgcctcgccatcctgttcgaggaggtgatgcggggcaagttcgggaagaagcacatgatcgccggcgtcctgttcaccttcgtgctcctgctgtccgggcagatcacgtggcgcgacatggcgcacaccctcatcatgatcggcagcaacgcctccgaccggatgggcatgggggtgacctacctggccctgatcgccaccttcaagatccagcccttcctcgccctgggcttcttcctgcgcaagctcacgagccgggagaacctgctgctcggggtcggcctggcgatggccaccaccctgcagctccccgaggacatcgagcagatggccaacggcatcgccctggggctgatgaccctcaagctgatcacgcagttcgagacctaccagctgtggaccgcgctcgtgagcctgacctgctccaacacgatcttcaccctgaccgtggcctggcgcaccgccacgctcatcctggccggcgtcagcctgctcccgctgtgccagtccagctccatgcggaagaccgactggctgcccatgaccgtggccgcgatgggggtgccgcccctgccgctgttcatcttcagcctgaaggacacccccaagcgccgctcctggcccctcaacgagggcgtgatggccgtggggctggtcagcatcctggcctccagcctcctgcggaacgacgtgcccatggccggcccgctggtggccggcgggctcctgatcgcgtgctacgtcatcacgggcacctccgccgacctgaccgtggagaaggccgccgacgtgacctgggaggaggaggccgagcagacgggggtcagccacaacctcatgatcaccgtggacgacgacggcaccatgcgcatcaaggacgacgagaccgagaacatcctgaccgtgctgctcaagacggcgctgctgatcgtctccgggatcttcccctacagcatccccgccaccctcctggtgtggcacacctggcagaagcagacccagcggtccggcgtgctgtgggacgtccccagcccgcccgagacgcagaaggccgagctcgaggagggcgtgtaccgcatcaagcagcaggggatcttcggcaagacccaggtgggggtcggcgtgcagaaggagggggtgttccacaccatgtggcacgtcacccggggcgccgtgctgacgcacaacggcaagcgcctggagcccaactgggcctccgtgaagaaggacctcatcagctacgggggcgggtggcggctgtccgcgcagtggcagaagggcgaggaggtccaggtgatcgccgtggagcccgggaagaacccgaagaacttccagaccatgcccggcatcttccagaccaccacgggcgagatcggggccatcgccctggacttcaagcccggcaccagcgggagcccgatcatcaaccgcgagggcaaggtcgtgggcctgtacgggaacggcgtggtcaccaagaacgggggctacgtgtccgggatcgcgcagaccaacgccgagcccgacggccccacgcccgagctcgaggaggagatgttcaagaagcggaacctgaccatcatggacctgcacccgggcagcgggaagacccgcaagtacctccccgccatcgtgcgggaggccatcaagcgccggctgcgcaccctgatcctcgcccccacgcgggtcgtggcggccgagatggaggaggccctgaagggcctgcccatccgctaccagaccaccgccatcaagtccgagcacaccgggcgggagatcgtggacctcatgtgccacgccacgttcaccatgcgcctgctgagcccggtccgggtgcccaactacaacctcatcatcatggacgaggcgcacttcaccgaccccgcctccatcgccgcccgcggctacatcagcacccgggtggggatgggcgaggccgcggccatcttcatgacggccacgccgcccggcaccgccgaggcgttcccccagtccaacgcccccatccaggacgaggagcgcgacatccccgagcgcagctggaactccgggaacgagtggatcaccgacttcgtcggcaagacggtgtggttcgtgcccagcatcaaggccgggaacgacatcgccaactgcctgcggaagaacggcaagaaggtcatccagctgtcccgcaagaccttcgacaccgagtaccagaagacccggctcaacgactgggacttcgtggtgacgaccgacatcagcgagatgggggccaacttcaaggcggaccgcgtcatcgacccccggcgctgcctgaagcccgtgatcctgaccgacggccccgagcgggtgatcctcgccggcccgatgcccgtcaccgccgcctccgccgcgcagcgccgggggcgcgtgggccggaacccccagaaggagaacgaccagtacatcttcacggggcagcccctgaacaacgacgaggaccacgcccactggaccgaggccaagatgctgctcgacaacatcaacaccccggagggcatcatccccgccctgttcgagcccgagcgcgagaagtccgccgcgatcgacggggagtaccggctgaagggcgagtcccgcaagaccttcgtggagctcatgcggcgcggcgacctgcccgtctggctggcccacaaggtggccagcgaggggatcaagtacaccgaccggaagtggtgcttcgacggcgagcgcaacaaccagatcctcgaggagaacatggacgtcgagatctggacgaaggagggggagcggaagaagctgcgcccgcgctggctggacgcccggacctactccgaccccctcgcgctgaaggagttcaaggacttcgccgccggccgcaagagcatcgccctggacctcgtgaccgagatcggccgggtgccctcccacctggcccaccgcacccggaacgcgctggacaacctcgtcatgctgcacacgagcgagcacgggggccgcgcctaccggcacgccgtggaggagctgccggagaccatggagaccctcctgctgctcgggctgatgatcctgctcaccggcggggccatgctgttcctgatcagcggcaagggcatcgggaagacgtccatcggcctcatctgcgtgatcgtcagctccgggatgctgtggatggccgacgtgcccctgcagtggatcgcgagcgccatcgtgctcgagttcttcatgatggtcctgctgatccccgagcccgagaagcagcgcaccccgcaggacaaccagctcgcctacgtggtgatcggcatcctgaccctggccgccatcgtcaccgcgaacgagatggggctcctggagacgaccaagcgggacctgggcatgtccaaggagcccggcgtggtgagccccacctcctacctcgacgtcgacctgcaccccgccagcgcctggaccctgtacgccgtggccacgaccgtgatcaccccgatgctccgccacaccatcgagaactccacggcgaacgtcagcctggccgccatcgccaaccaggcggtggtgctgatggggctcgacaagggctggcccatctccaagatggacctgggggtccccctgctcgccctgggctgctacagccaggtgaaccccctgaccctcaccgccgccgtgctgctgctcgtcacccactacgccatcatcgggccgggcctgcaggcgaaggccacgcgggaggcccagaagcgcaccgccgccggcatcatgaagaaccccaccgtggacgggatcatgaccatcgacctggaccccgtgatctacgactccaagttcgagaagcagctcggccaggtcatgctgctggtgctctgcgcggtgcagctgctgctcatgcggacgagctgggccctgtgcgaggccctgaccctcgccaccgggcccatcaccacgctgtgggagggctccccgggcaagttctggaacaccaccatcgccgtcagcatggcgaacatcttccgcgggtcctacctggccggcgccgggctcgccttcagcatcatgaagtccgtgggcaccgggaagcggggcacgggcagccagggggagaccctgggcgagaagtggaagaagaagctgaaccagctcagccgcaaggagttcgacctgtacaagaagtccgggatcaccgaggtggaccggaccgaggcgaaggagggcctgaagcgcggggagaccacgcaccacgccgtcagccggggctccgccaagctccagtggttcgtggagcgcaacatggtgatccccgagggccgggtcatcgacctggggtgcggccgcgggggctggagctactactgcgccgggctgaagaaggtgaccgaggtgcgcggctacaccaagggcgggcccggccacgaggagcccgtcccgatgtccacctacgggtggaacatcgtgaagctcatgagcggcaaggacgtgttctacctgccgcccgagaagtgcgacacgctgctgtgcgacatcggggagtccagcccctccccgaccgtcgaggagagccggaccatccgcgtgctcaagatggtggagccctggctgaagaacaaccagttctgcatcaaggtcctgaacccctacatgcccaccgtgatcgagcacctcgagcggctgcagcgcaagcacggcggcatgctggtgcggaacccgctctcccgcaacagcacgcacgagatgtactggatctccaacgggaccggcaacatcgtcagctccgtgaacatggtgagccggctgctgctcaaccgcttcaccatgacccaccggcgccccacgatcgagaaggacgtcgacctgggggccggcacccggcacgtgaacgcggagcccgagaccccgaacatggacgtcatcggcgagcgcatcaagcggatcaaggaggagcactccagcacctggcactacgacgacgagaacccctacaagacgtgggcctaccacgggtcctacgaggtgaaggccaccggcagcgccagctccatgatcaacggggtggtcaagctgctcaccaagccctgggacgtggtgcccatggtcacccagatggccatgacggacaccaccccgttcggccagcagcgcgtgttcaaggagaaggtggacacccggacgccccgccccatgcccgggacccggaaggtcatggagatcaccgcggagtggctgtggcgcaccctgggccggaacaagcgcccgcgcctctgcacgcgggaggagttcaccaagaaggtgcgcaccaacgccgccatgggcgccgtgttcaccgaggagaaccagtgggacagcgcccgggcggccgtcgaggacgaggagttctggaagctggtggaccgcgagcgggagctgcacaagctcgggaagtgcggctcctgcgtgtacaacatgatggggaagcgcgagaagaagctgggcgagttcgggaaggccaagggcagccgggccatctggtacatgtggctgggcgcgcgctacctcgagttcgaggccctggggttcctgaacgaggaccactggttctcccgggagaacagctactccggcgtcgagggggagggcctccacaagctggggtacatcctgcgcgacatcagcaagatccccggcggcgccatgtacgccgacgacacggccgggtgggacacccggatcaccgaggacgacctccacaacgaggagaagatcacccagcagatggaccccgagcaccgccagctggcgaacgccatcttcaagctgacgtaccagaacaaggtggtgaaggtccagcggcccaccccgaagggcaccgtgatggacatcatctcccgcaaggaccagcgggggagcggccaggtgggcacctacgggctcaacaccttcacgaacatggaggcccagctggtccgccagatggagggcgagggggtgctgtccaaggtggacctcgagaacccccacctcctggagaagaagatcacccagtggctcgagaccaagggcgtcgagcggctgcgccggatggccatcagcggggacgactgcgtggtgaagcccatcgacgaccgcttcgccaacgcgctgctcgccctgaacgacatgggcaaggtccggaaggacatcccccagtggcagccgtccaagggctggcacgactggcagcaggtccccttctgcagccaccacttccacgagctgatcatgaaggacgggcgcaagctcgtggtcccctgccgcccccaggacgagctgatcggccgggcccgcatctcccagggggccggctggagcctgaaggagaccgcctgcctcgggaaggcgtacgcccagatgtggtccctgatgtacttccaccggcgcgacctgcggctcgccagcaacgccatctgctccgccgtgccggtgcactgggtccccacgagccgcaccacctggagcatccacgcgcaccaccagtggatgaccacggaggacatgctgaccgtgtggaaccgggtgtggatcgaggacaacccctggatggaggacaagacccccgtcaccacgtgggaggacgtgccgtacctgggcaagcgcgaggaccagtggtgcggctccttcatcgggctcaccagccgggccacctgggcccagaacatcctgaccgccatccagcaggtccgctccctgatcggcgacgaggagttcctcgactacatgcccagcatgaagcggttccgcaaggaggaggagtccgagggggcgatctggtga

SEQ ID NO: 10123 - RNA, 9873 nt, synthetic construct
  misc_feature 1..9873: note = derived and/or modified CDS sequence (opt1) from DENV-3__FJ744740__SS-prME
  source 1..9873: mol_type = other RNA
accagcctgtgcctcatgatgatgctgcccgccaccctggccttccacctcaccagccgggacggggagccgcggatgatcgtggccaagaacgagcggggcaagagcctgctgttcaagaccgcctccggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacggcacgtgcaaccaggccggggagcaccggcgcgacaagcggtccgtcgcgctggcgccccacgtgggcatgggcctggacacccgcacccagacctggatgagcgccgagggggcctggcgccaggtggagaaggtggagacgtgggcgctccgccacccgggcttcaccatcctggccctgttcctcgcccactacatcgggacctccctgacccagaaggtggtgatcttcatcctgctcatgctggtcacgcccagcatgaccatgcggtgcgtgggcgtggggaaccgcgacttcgtcgagggcctgtccggcgccacctgggtggacgtggtcctcgagcacgggggctgcgtgaccacgatcgccaagaacaagcccaccctggacatcgagctgcagaagaccgaggcgacccagctcgccacgctgcggaagctgtgcatcgaggggaagatcaccaacatcaccaccgacagccgctgccccacgcagggcgaggccatcctcccggaggagcaggaccagaactacgtgtgcaagcacacctacgtcgaccggggctgggggaacggctgcgggctgttcggcaaggggtccctggtgacctgcgccaagttccagtgcctcgagcccatcgagggcaaggtggtccagcacgagaacctgaagtacaccgtgatcatcacggtgcacaccggcgaccagcaccaggtcgggaacgacacccagggcgtgaccgtcgagatcacgccccaggccagcaccgtggaggcgatcctgcccgagtacgggaccctcggcctggagtgctccccgcgcaccgggctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcggctcccaggagggggcgatgcacaccgccctgaccggcgccacggagatccagaacagcgggggcacctccatcttcgccgggcacctgaagtgccggctcaagatggacaagctggagctgaagggcatgagctacgccatgtgcctcaacaccttcgtgctgaagaaggaggtgtccgagacccagcacggcacgatcctgatcaaggtcgagtacaagggggaggacgcgccgtgcaagatccccttcagcaccgaggacggccaggggaaggcccacaacggccgcctgatcaccgccaaccccgtggtgaccaagaaggaggagcccgtcaacatcgaggccgagccgcccttcggcgagagcaacatcgtgatcggggtgggcgacaaggcgctcaagatcaactggtacaagaaggggtccagcatcggcaagatgttcgaggccacggcccgcggggcccgccggatggccatcctgggcgacaccgcgtgggacttcggctccgtcgggggcgtgctgaacagcctcgggaagatggtgcaccagatcttcggctccgcctacaccgccctgttcagcggggtctcctggatcatgaagatcggcatcggcgtgctgctcacctggatcgggctgaacagcaagaacacgtccatgagcttctcctgcatcgtgatcggcatcatcaccctgtacctcggggccgtcgtgcaggccgacatgggctgcgtgatcaactggaaggggaaggagctgaagtgcggcagcggcatcttcgtcaccaacgaggtgcacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtcgtggtgggcgacatcatcggggtcctggagcagggcaagcgcaccctcacgccccagccgatggagctgaagtactcctggaagacctggggcaaggccaagatcgtgacggccgagacccagaacagctccttcatcatcgacgggcccaacacccccgagtgccccagcgcctcccgggcgtggaacgtgtgggaggtcgaggactacggcttcggggtgttcaccacgaacatctggctgaagctccgcgaggtgtacacccagagctgcgaccaccggctgatgagcgccgccatcaaggacgagcgcgccgtccacgccgacatgggctactggatcgagtcccagaagaacggcagctggaagctggagaaggcgtccttcatcgaggtgaagacctgcacctggcccaagagccacaccctctggtccaacggggtgctggagagcgacatgatcatccccaagtccctggccggccccatcagccagcacaaccaccggccggggtaccacacgcagaccgccggcccctggcacctcgggaagctggagctggacttcaactactgcgagggcaccaccgtcgtgatcacggagaactgcggcacccgcgggccctccctccggaccaccacggtgagcggcaagctgatccacgagtggtgctgccgctcctgcaccctgcccccgctccggtacatgggggaggacggctgctggtacgggatggagatccgccccatcaacgagaaggaggagaacatggtcaagagcctggtgtccgccggcagcggcaaggtggacaacttcaccatggggatcctgtgcctcgccatcctgttcgaggaggtcatgcggggcaagttcgggaagaagcacatgatcgcgggcgtgctgttcaccttcgtgctcctgctgtccgggcagatcacgtggcgcgacatggcccacaccctcatcatgatcggcagcaacgcctccgaccggatgggcatgggggtcacctacctggccctgatcgccaccttcaagatccagcccttcctcgcgctgggcttcttcctgcgcaagctcacgagccgggagaacctgctgctcggggtgggcctggccatggccaccaccctgcagctccccgaggacatcgagcagatggccaacggcatcgcgctggggctgatgaccctcaagctgatcacgcagttcgagacctaccagctgtggaccgccctcgtgagcctgacctgctccaacacgatcttcaccctgaccgtcgcctggcgcaccgccacgctcatcctggccggcgtgagcctgctcccgctgtgccagtccagctccatgcggaagaccgactggctgcccatgaccgtcgcggccatgggggtgccgcccctgccgctgttcatcttcagcctgaaggacacccccaagcgccgctcctggcccctcaacgagggcgtgatggccgtcgggctggtgagcatcctggcctccagcctcctgcggaacgacgtgcccatggccggcccgctggtcgcgggcgggctcctgatcgcctgctacgtgatcacgggcacctccgccgacctgaccgtggagaaggccgccgacgtcacctgggaggaggaggcggagcagacgggggtgagccacaacctcatgatcaccgtggacgacgacggcaccatgcgcatcaaggacgacgagaccgagaacatcctgaccgtcctgctcaagacggccctgctgatcgtgtccgggatcttcccctacagcatccccgccaccctcctggtgtggcacacctggcagaagcagacccagcggtccggcgtcctgtgggacgtgcccagcccgcccgagacgcagaaggccgagctcgaggagggcgtgtaccgcatcaagcagcaggggatcttcggcaagacccaggtcggggtgggcgtgcagaaggagggggtcttccacaccatgtggcacgtgacccggggcgccgtgctgacgcacaacggcaagcgcctggagcccaactgggcgtccgtcaagaaggacctcatcagctacgggggcgggtggcggctgtccgcccagtggcagaagggcgaggaggtccaggtgatcgccgtcgagcccgggaagaacccgaagaacttccagaccatgcccggcatcttccagaccaccacgggcgagatcggggccatcgcgctggacttcaagcccggcaccagcgggagcccgatcatcaaccgcgagggcaaggtggtgggcctgtacgggaacggcgtcgtgaccaagaacgggggctacgtgtccgggatcgcccagaccaacgccgagcccgacggccccacgcccgagctcgaggaggagatgttcaagaagcggaacctgaccatcatggacctgcacccgggcagcgggaagacccgcaagtacctccccgccatcgtccgggaggccatcaagcgccggctgcgcaccctgatcctcgcgcccacgcgggtggtggccgccgagatggaggaggccctgaagggcctgcccatccgctaccagaccaccgccatcaagtccgagcacaccgggcgggagatcgtcgacctcatgtgccacgcgacgttcaccatgcgcctgctgagcccggtgcgggtgcccaactacaacctcatcatcatggacgaggcccacttcaccgaccccgcctccatcgccgcccgcggctacatcagcacccgggtcgggatgggcgaggcggccgccatcttcatgacggccacgccgcccggcaccgcggaggccttcccccagtccaacgcccccatccaggacgaggagcgcgacatccccgagcgcagctggaactccgggaacgagtggatcaccgacttcgtgggcaagacggtgtggttcgtccccagcatcaaggccgggaacgacatcgccaactgcctgcggaagaacggcaagaaggtgatccagctgtcccgcaagaccttcgacaccgagtaccagaagacccggctcaacgactgggacttcgtggtcacgaccgacatcagcgagatgggggcgaacttcaaggccgaccgcgtgatcgacccccggcgctgcctgaagcccgtgatcctgaccgacggccccgagcgggtcatcctcgccggcccgatgcccgtgaccgccgcctccgcggcccagcgccgggggcgcgtgggccggaacccccagaaggagaacgaccagtacatcttcacggggcagcccctgaacaacgacgaggaccacgcccactggaccgaggccaagatgctgctcgacaacatcaacaccccggagggcatcatccccgccctgttcgagcccgagcgcgagaagtccgcggccatcgacggggagtaccggctgaagggcgagtcccgcaagaccttcgtcgagctcatgcggcgcggcgacctgcccgtgtggctggcccacaaggtcgccagcgaggggatcaagtacaccgaccggaagtggtgcttcgacggcgagcgcaacaaccagatcctcgaggagaacatggacgtggagatctggacgaaggagggggagcggaagaagctgcgcccgcgctggctggacgcgcggacctactccgaccccctcgccctgaaggagttcaaggacttcgccgccggccgcaagagcatcgccctggacctcgtgaccgagatcggccgggtcccctcccacctggcgcaccgcacccggaacgccctggacaacctcgtgatgctgcacacgagcgagcacgggggccgcgcctaccggcacgccgtggaggagctgccggagaccatggagaccctcctgctgctcgggctgatgatcctgctcaccggcggggccatgctgttcctgatcagcggcaagggcatcgggaagacgtccatcggcctcatctgcgtcatcgtgagctccgggatgctgtggatggcggacgtgcccctgcagtggatcgccagcgccatcgtcctcgagttcttcatgatggtgctgctgatccccgagcccgagaagcagcgcaccccgcaggacaaccagctcgcctacgtggtcatcggcatcctgaccctggccgcgatcgtgaccgccaacgagatggggctcctggagacgaccaagcgggacctgggcatgtccaaggagcccggcgtggtcagccccacctcctacctcgacgtggacctgcaccccgccagcgcctggaccctgtacgccgtggcgacgaccgtcatcaccccgatgctccgccacaccatcgagaactccacggccaacgtgagcctggccgccatcgcgaaccaggccgtggtcctgatggggctcgacaagggctggcccatctccaagatggacctgggggtgcccctgctcgccctgggctgctacagccaggtgaaccccctgaccctcaccgccgccgtcctgctgctcgtgacccactacgcgatcatcgggccgggcctgcaggccaaggccacgcgggaggcccagaagcgcaccgccgcgggcatcatgaagaaccccaccgtggacgggatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgccaccgggcccatcaccacgctgtgggagggctccccgggcaagttctggaacaccaccatcgcggtgagcatggccaacatcttccgcgggtcctacctggccggcgccgggctcgcgttcagcatcatgaagtccgtgggcaccgggaagcggggcacgggcagccagggggagaccctgggcgagaagtggaagaagaagctgaaccagctcagccgcaaggagttcgacctgtacaagaagtccgggatcaccgaggtcgaccggaccgaggccaaggagggcctgaagcgcggggagaccacgcaccacgccgtgagccggggctccgccaagctccagtggttcgtggagcgcaacatggtcatccccgagggccgggtgatcgacctggggtgcggccgcgggggctggagctactactgcgccgggctgaagaaggtgaccgaggtccgcggctacaccaagggcgggcccggccacgaggagcccgtgccgatgtccacctacgggtggaacatcgtgaagctcatgagcggcaaggacgtcttctacctgccgcccgagaagtgcgacacgctgctgtgcgacatcggggagtccagcccctccccgaccgtggaggagagccggaccatccgcgtgctcaagatggtcgagccctggctgaagaacaaccagttctgcatcaaggtgctgaacccctacatgcccaccgtgatcgagcacctcgagcggctgcagcgcaagcacggcggcatgctggtccggaacccgctctcccgcaacagcacgcacgagatgtactggatctccaacgggaccggcaacatcgtgagctccgtgaacatggtcagccggctgctgctcaaccgcttcaccatgacccaccggcgccccacgatcgagaaggacgtggacctgggggcgggcacccggcacgtcaacgccgagcccgagaccccgaacatggacgtgatcggcgagcgcatcaagcggatcaaggaggagcactccagcacctggcactacgacgacgagaacccctacaagacgtgggcctaccacgggtcctacgaggtgaaggccaccggcagcgccagctccatgatcaacggggtcgtgaagctgctcaccaagccctgggacgtggtccccatggtgacccagatggcgatgacggacaccaccccgttcggccagcagcgcgtgttcaaggagaaggtcgacacccggacgccccgccccatgcccgggacccggaaggtgatggagatcaccgccgagtggctgtggcgcaccctgggccggaacaagcgcccgcgcctctgcacgcgggaggagttcaccaagaaggtgcgcaccaacgccgccatgggcgccgtcttcaccgaggagaaccagtgggacagcgcgcgggccgccgtggaggacgaggagttctggaagctggtggaccgcgagcgggagctgcacaagctcgggaagtgcggctcctgcgtctacaacatgatggggaagcgcgagaagaagctgggcgagttcgggaaggccaagggcagccgggcgatctggtacatgtggctgggcgcccgctacctcgagttcgaggccctggggttcctgaacgaggaccactggttctcccgggagaacagctactccggcgtggagggggagggcctccacaagctggggtacatcctgcgcgacatcagcaagatccccggcggcgccatgtacgccgacgacacggcggggtgggacacccggatcaccgaggacgacctccacaacgaggagaagatcacccagcagatggaccccgagcaccgccagctggccaacgccatcttcaagctgacgtaccagaacaaggtggtcaaggtgcagcggcccaccccgaagggcaccgtgatggacatcatctcccgcaaggaccagcgggggagcggccaggtcggcacctacgggctcaacaccttcacgaacatggaggcccagctggtgcgccagatggagggcgagggggtgctgtccaaggtcgacctcgagaacccccacctcctggagaagaagatcacccagtggctcgagaccaagggcgtggagcggctgcgccggatggccatcagcggggacgactgcgtggtcaagcccatcgacgaccgcttcgcgaacgccctgctcgccctgaacgacatgggcaaggtgcggaaggacatcccccagtggcagccgtccaagggctggcacgactggcagcaggtccccttctgcagccaccacttccacgagctgatcatgaaggacgggcgcaagctcgtcgtgccctgccgcccccaggacgagctgatcggccgggcccgcatctcccagggggccggctggagcctgaaggagaccgcgtgcctcgggaaggcctacgcccagatgtggtccctgatgtacttccaccggcgcgacctgcggctcgccagcaacgccatctgctccgcggtgccggtccactgggtgcccacgagccgcaccacctggagcatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcggctccctcatcgggctgaccagccgggccacctgggcccagaacatcctgaccgcgatccagcaggtccgctccctcatcggcgacgaggagttcctggactacatgcccagcatgaagcggttccgcaaggaggaggagtccgagggggccatctggtga

SEQ ID NO: 10124 - RNA, 9873 nt, synthetic construct
  misc_feature 1..9873: note = derived and/or modified CDS sequence (opt1) from DENV-3__GQ868593__SS-prME
  source 1..9873: mol_type = other RNA
accagcctctgcctcatgatgatgctgcccgcgaccctggcgttccacctcaccagccgggacggcgagccccggatgatcgtggggaagaacgagcgcggcaagagcctgctgttcaagaccgcgagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacctgggccctgcgccaccccgggttcaccatcctcgcgctgttcctggcccactacatcggcacctccctcacccagaaggtggtgatcttcatcctgctgatcctcgtcacccccagcatggccatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccatcctgcccgaggagcaggaccagaactacgtgtgcaagcacacgtacgtcgaccgggggtggggcaacgggtgcggcctcttcgggaagggctccctggtgacctgcgccaagttccagtgcctggagagcatcgagggcaaggtggtccagcacgagaacctcaagtacaccgtgatcatcaccgtgcacacgggggaccagcaccaggtcggcaacgagacccagggggtgaccgccgagatcacgccccaggcgtccacggtcgaggccatcctgcccgagtacggcaccctggggctcgagtgcagcccccgcaccggcctggacttcaacgagatgatcctgctcaccatgaagaacaaggcctggatggtgcaccggcagtggttcttcgacctgccgctgccctggacctccggcgccacgaccgagacccccacctggaaccgcaaggagctcctggtgacgttcaagaacgcccacgcgaagaagcaggaggtcgtggtgctggggagccaggagggcgccatgcacaccgccctcaccggggccaccgagatccagaactccggcgggacgagcatcttcgccggccacctgaagtgccggctgaagatggacaagctcgagctgaagggcatgtcctacgcgatgtgcctgaacaccttcgtcctcaagaaggaggtgagcgagacccagcacgggaccatcctgatcaaggtggagtacaagggcgaggacgccccctgcaagatccccttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctgaagatcaactggtacaagaagggcagctccatcgggaagatgttcgaggccaccgcccggggcgcccgccggatggcgatcctcggcgacacggcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacaccagcatgtccttcagctgcatcgccatcgggatcatcacgctgtacctgggcgcggtcgtgcaggccgacatggggtgcgtgatcaactggaagggcaaggagctcaagtgcggctccgggatcttcgtcaccaacgaggtgcacacctggaccgagcagtacaagttccaggccgacagccccaagcgcctggccacggccatcgcgggcgcctgggagaacggggtgtgcggcatccgctccaccacccggatggagaacctgctctggaagcagatcgccaacgagctgaactacatcctgtgggagaacaacatcaagctcaccgtcgtggtgggggacatcatcggcgtcctggagcagggcaagcgcacgctgacgccccagcccatggagctcaagtacagctggaagacctgggggaaggccaagatcgtgaccgcggagacgcagaactccagcttcatcatcgacggcccgaacacccccgagtgcccctccgccagccgggcctggaacgtgtgggaggtcgaggactacgggttcggcgtgttcaccaccaacatctggctgaagctgcgcgaggtgtacacgcagctctgcgaccaccggctgatgagcgccgccgtcaaggacgagcgcgcggtgcacgccgacatgggctactggatcgagtcccagaagaacgggagctggaagctggagaaggcctccctcatcgaggtgaagacctgcacctggcccaagagccacaccctgtggtccaacggcgtcctggagagcgacatgatcatcccgaagtccctcgccgggcccatcagccagcacaaccaccggcccggctaccacacccagacggccgggccgtggcacctgggcaagctggagctcgacttcaactactgcgagggcaccaccgtggtgatcaccgagaactgcgggacgcgcggcccctccctgcggaccaccaccgtcagcgggaagctgatccacgagtggtgctgccgctcctgcacgctgccgcccctccggtacatgggcgaggacgggtgctggtacggcatggagatccgcccgatcaacgagaaggaggagaacatggtcaagagcctggcgtccgccggcagcgggaaggtggacaacttcaccatgggcgtcctctgcctggccatcctgttcgaggaggtgatgcgggggaagttcggcaagaagcacatgatcgccggggtgctcctgaccttcgtcctgctcctgtccggccagatcacctggcgcgacatggcccacacgctgatcatgatcggcagcaacgcgtccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggccctgaagctcatcacccagttcgagacctaccagctgtggacggcgctggtcagcctgacctgctccaacaccatcttcaccctgacggtggcctggcgcaccgccaccctgatcctcgccggggtgagcctgctgcccgtctgccagtccagctccatgcggaagaccgactggctcccgatggccgtggcggccatgggcgtgccgcccctccccctgttcatcttcagcctcaaggacacgctgaagcgccgctcctggccgctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagacggagaacatcctcaccgtgctgctgaagaccgccctcctgatcgtctccggcatcttcccctacagcatcccggccaccctgctcgtgtggcacacctggcagaagcagacgcagcggtccggcgtgctgtgggacgtcccctccccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacccacaacgggaagcgcctggagccgaactgggcctccgtgaagaaggacctgatcagctacggcgggggctggcggctgtccgcccagtggcagaagggggaggaggtccaggtgatcgccgtggagcccggcaagaaccccaagaacttccagaccatgcccggcatcttccagaccacgaccggggagatcggcgccatcgcgctcgacttcaagccggggaccagcggcagccccatcatcaaccgcgagggcaaggtcgtggggctgtacggcaacggggtggtcaccaagaacggcgggtacgtgtccggcatcgcccagacgaacgccgagcccgacggcccgacccccgagctggaggaggagatgttcaagaagcggaacctcaccatcatggacctgcaccccgggagcggcaagacccgcaagtacctgcccgccatcgtgcgggaggccatcaagcgccggctccgcacgctgatcctggcgccgacccgggtcgtggccgccgagatggaggaggccctcaaggggctgcccatccgctaccagaccaccgccacgaagtccgagcacaccggccgggagatcgtggacctgatgtgccacgcgaccttcaccatgcgcctcctgagccccgtccgggtgcccaactacaacctgatcatcatggacgaggcccacttcacggacccggcctccatcgccgcgcgcgggtacatcagcacccgggtgggcatgggcgaggccgccgccatcttcatgaccgccacgccgcccgggacggcggacgccttcccccagtccaacgccccgatccaggacgaggagcgcgacatccccgagcgcagctggaactccggcaacgagtggatcaccgacttcgtcgggaagaccgtgtggttcgtgcccagcatcaaggccggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgcgaacttcaaggccgaccgggtcatcgacccccgccggtgcctcaagccggtgatcctgacggacggccccgagcgcgtgatcctggccgggcccatgcccgtcaccgccgcctccgcggcccagcggcgcggccgggtggggcgcaacccgcagaaggagaacgaccagtacatcttcaccggccagcccctcaacaacgacgaggaccacgcccactggaccgaggccaagatgctgctggacaacatcaacacgcccgaggggatcatccccgccctcttcgagccggagcgggagaagtccgccgccatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacggggagcggaacaaccagatcctggaggagaacatggacgtcgagatctggaccaaggagggcgagaagaagaagctccgcccccggtggctggacgcgcgcacctactccgaccccctggccctcaaggagttcaaggacttcgccgccggccgcaagagcatcgccctggacctggtgacggagatcgggcgggtgccgtcccacctcgcgcaccgcacccggaacgccctggacaacctggtcatgctccacaccagcgagcacggcgggcgcgcctaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtgatcgcgagctccggcatgctctggatggccgacgtccccctgcagtggatcgccagcgccatcgtgctggagttcttcatgatggtgctcctgatcccggagcccgagaagcagcgcacgccccaggacaaccagctggcctacgtcgtgatcgggatcctcacgctggcggccatcgtggccgccaacgagatgggcctgctcgagaccaccaagcgggacctgggcatgtccaaggagcccggggtcgtgagcccgacctcctacctggacgtggacctccaccccgcgagcgcctggacgctgtacgccgtcgccaccaccgtgatcacccccatgctgcgccacacgatcgagaactccaccgccaacgtgagcctcgcggccatcgccaaccaggccgtcgtgctgatgggcctggacaaggggtggcccatctccaagatggacctcggcgtgccgctgctggccctcgggtgctacagccaggtcaaccccctgaccctgaccgcggccgtgctcctgctggccacgcactacgccatcatcggccccggcctccaggccaaggcgacccgggaggcccagaagcgcaccgccgccgggatcatgaagaaccccaccgtggacggcatcatgacgatcgacctggacccggtcatctacgactccaagttcgagaagcagctgggccaggtgatgctcctggtgctgtgcgcggtccagctcctgctgatgcggaccagctgggccctctgcgaggccctgaccctggccaccggccccatcacgaccctctgggagggctcccccgggaagttctggaacaccaccatcgccgtgagcatggcgaacatcttccgcggctcctacctggccggggccggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtcgaccggacggaggccaaggaggggctgaagcgcggcgagatcacccggcacgcggtgagccgcggctccgccaagctgcagtggttcgtggagcggaacatggtcatccccgaggggcgcgtgatcgacctcggctgcgggcggggcgggtggagctactactgcgccggcctgaagaaggtgaccgaggtccgcggctacaccaagggcgggccggggcacgaggagcccgtgcccatgtccacctacggctggaacatcgtgaagctgatgagcgggaaggacgtcttctacctgcccccggagaagtgcgacacgctcctgtgcgacatcggcgagtccagcccctcccccaccgtggaggagagccgcaccatccgggtgctgaagatggtcgagccctggctcaagaacaaccagttctgcatcaaggtgctgaacccgtacatgcccaccgtgatcgagcacctggagcgcctccagcggaagcacggcgggatgctggtccgcaaccccctgtcccggaacagcacgcacgagatgtactggatctccaacggcaccgggaacatcgtgagctccgtgaacatggtcagccgcctcctgctgaaccggttcaccatgacccaccgccggcccacgatcgagaaggacgtggacctcggcgccggcacccgccacgtgaacgccgagccggagacccccaacatggacgtcatcggggagcggatcaagcgcatcaaggaggagcacaactccacctggcactacgacgacgagaacccctacaagacgtgggcgtaccacggcagctacgaggtgaaggccaccgggtccgccagcagcatgatcaacggcgtcgtgaagctgctgaccaagccgtgggacgtggtccccatggtgatccagatggccatgaccgacacgacccccttcgggcagcagcgggtgttcaaggagaaggtcgacacccgcacgccccggccgatgcccggcacgcgcaaggtgatggagatcaccgcggagtggctctggcggaccctgggccgcaacaagcggccccgcctgtgcacccgcgaggagttcacgaagaaggtgcggaccaacgccgccatgggggccgtcttcaccgaggagaaccagtgggactccgcccgcgcggccgtggaggacgaggagttctggaagctcgtggaccgggagcgcgagctgcacaagctgggcaagtgcgggagctgcgtctacaacatgatgggcaagcgggagaagaagctcggggagttcggcaaggccaagggctcccgcgccatctggtacatgtggctgggggcccggtacctggagttcgaggcgctcggcttcctgaacgaggaccactggttcagccgcgagaactcctacagcggggtggagggcgaggggctgcacaagctcggctacatcctgcgggacatctccaagatccccggcggggccatgtacgccgacgacaccgccggctgggacacgcgcatcaccgaggacgacctgcacaacgaggagaagatcacccagcagatggacccggagcaccggcagctcgccaacgcgatcttcaagctgacctaccagaacaaggtggtcaaggtgcagcgccccacgcccaaggggaccgtgatggacatcatcagccggaaggaccagcgcggctccggccaggtcgggacctacggcctgaacaccttcacgaacatggaggcccagctcgtgcggcagatggagggggagggcgtgctgagcaaggccgacctggagaacccccacctcctggagaagaagatcacccagtggctggagaccaagggggtcgagcgcctcaagcggatggccatctccggcgacgactgcgtggtgaagccgatcgacgaccgcttcgccaacgcgctgctggccctcaacgacatgggcaaggtccggaaggacatcccccagtggcagcccagcaaggggtggcacgactggcagcaggtccccttctgctcccaccacttccacgagctgatcatgaaggacggccgcaagctggtggtcccgtgccggccccaggacgagctcatcgggcgcgcccgcatcagccagggcgccgggtggtccctgaaggagaccgcgtgcctgggcaaggcctacgcccagatgtggagcctcatgtacttccaccggcgcgacctgcggctggcctccaacgccatctgcagcgcggtgcccgtgcactgggtccccacctcccgcacgacctggagcatccacgcccaccaccagtggatgaccaccgaggacatgctcacggtgtggaaccgggtgtggatcgaggacaacccgtggatggaggacaagacccccgtcaccacctgggaggacgtgccctacctgggcaagcgcgaggaccagtggtgcgggagcctgatcggcctcacgtcccgggccacctgggcccagaacatcctgaccgccatccagcaggtccgcagcctgatcgggaacgaggagttcctcgactacatgccctccatgaagcggttcaagaaggaggaggagagcgagggcgcgatctggtga

SEQ ID NO: 10125 - RNA, 9873 nt, synthetic construct
  misc_feature 1..9873: note = derived and/or modified CDS sequence (opt1) from DENV-3__FJ898459__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaaggtgcagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtcgcctggcgcacggcgaccctgatcctcgccggggtgagcctgctgccggtctgccagtccagctccatgcggaagaccgactggctccccatggccgtggccgccatgggcgtgccgcccctcccgctgttcatcttcagcctcaaggacaccctgaagcgccgctcctggcccctgaacgagggggtcatggcggtgggcctcgtgagcatcctggcctccagcctgctccggaacgacgtccccatggccggccccctggtggccgggggcctgctcatcgcctgctacgtgatcacggggacctccgcggacctgaccgtcgagaaggccgccgacatcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcgtgttcccgtacagcatccccgcgaccctgctcgtctggcacacctggcagaagcagacccagcggtccggcgtgctgtgggacgtgcccagcccgcccgagacgcagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggcctccgtgaagaaggacctgatcagctacggcgggggctggcggctctccgcgcagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagacgaacgcggagccggacggccccacccccgagctggaggaggagatgttcaagaagcggaacctcaccatcatggacctgcaccccgggagcggcaagacccgcaagtacctgccggccatcgtgcgggaggccatcaagcgccggctccgcacgctgatcctggcccccacccgggtggtcgccgcggagatggaggaggccctcaaggggctgcccatccgctaccagaccaccgccacgaagtccgagcacaccggccgggagatcgtggacctgatgtgccacgccaccttcaccatgcgcctcctgagccccgtgcgggtcccgaactacaacctgatcatcatggacgaggcccacttcacggaccccgcgtccatcgccgcccgcgggtacatcagcacccgggtgggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaaggcggaccgggtgatcgacccgcgccggtgcctcaagcccgtgatcctgacggacggccccgagcgcgtcatcctggccgggcccatgccggtgaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtcgagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtgacggagatcgggcgggtcccctcccacctcgcccaccgcacccggaacgcgctggacaacctggtgatgctccacaccagcgagcacggcgggcgcgcctaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcgcacgccccaggacaaccagctggcctacgtcgtgatcgggatcctcacgctggccgcgatcatcgccgccaacgagatgggcctgctcgagaccaccaagcgggacctgggcatgtccaaggagccgggggtggtcagccccacctcctacctggacgtggacctccaccccgccagcgcgtggacgctgtacgccgtggccaccaccgtcatcacccccatgctgcgccacacgatcgagaactccaccgccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcggaccagctgggccctctgcgaggcgctgaccctggccaccggccccatcacgaccctctgggagggctcccccgggaagttctggaacaccaccatcgccgtcagcatggccaacatcttccgcggctcctacctggccggggcgggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagacgacccaccacgccgtcagccggggctccgccaagctgcagtggttcgtggagcgcaacatggtgatcccggaggggcgggtcatcgacctcggctgcgggcgcggcgggtggagctactactgcgcgggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgccggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggcgaccgggagcgcctccagcatgatcaacggcgtggtcaagctgctgaccaagccctgggacgtggtgcccatggtcacgcagatggccatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccggctgtgcacccgcgaggagttcaccaagaaggtgcgcaccaacgcggccatgggcgccgtgttcacggaggagaaccagtgggactccgccaaggccgcggtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgcgatgtacgccgacgacaccgccgggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcgcagctcatccggcagatggagggcgagggggtcctgagcaaggccgacctggagaacccccacctcccggagaagaagatcacccagtggctggagacgaagggcgtggagcgcctgaagcggatggccatctccggcgacgactgcgtggtcaagcccatcgacgaccgcttcgccaacgccctcctggcgctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggccggctggtccctccgcgagaccgcctgcctgggcaaggcgtacgcccagatgtggagcctgatgtacttccaccgccgggacctccgcctggcctccaacgccatctgcagcgccgtgcccgtccactgggtgccgacctcccggaccacgtggagcatccacgcgcaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgacctcccgcgccacgtgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10126 - RNA, 9873 nt, synthetic construct
  misc_feature 1..9873: note = derived and/or modified CDS sequence (opt1) from DENV-3__EU482555__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcggggtgatcaccctctacctgggcgccgtggtccaggcggacatggggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagatccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggacctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgacaagatggggatgggcgtgacctacctcgccctgatcgcgacgttcaagatccagcccttcctggccctcgggttcttcctgcggaagctgaccagccgcgagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatgttcaccctgaccgtcgcctggcggaccgcgacgctgatcctcgccggggtgagcctgctgccggtctgccagtccagctccatgcgcaagaccgactggctccccatggccgtggccgccatgggcgtgccgcccctcccgctgttcatcttcagcctcaaggacaccctgaagcggcgctcctggcccctgaacgagggggtcatggcggtgggcctcgtgagcatcctggcctccagcctgctccgcaacgacgtccccatggccggccccctggtggccgggggcctgctcatcgcctgctacgtgatcaccgggacgtccgcggacctgaccgtcgagaaggccgccgacatcacctgggaggaggaggccgagcagaccggcgtgagccacaacctgatgatcacggtggacgacgacgggaccatgcggatcaaggacgacgagaccgagaacatcctcaccgtcctgctgaagaccgccctcctgatcgtgtccggcgtgttcccgtacagcatccccgcgacgctgctcgtctggcacacctggcagaagcagacccagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacctacaacgggaagcggctggagcccaactgggcctccgtgaagaaggacctgatcagctacggcgggggctggcgcctctccgcgcagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgggagggcaaggtggtcgggctgtacggcaacggggtggtgaccaagaacggcgggtacgtctccggcatcgcccagaccaacgcggagccggacggccccacgcccgagctggaggaggagatgttcaagaagcgcaacctcaccatcatggacctgcaccccgggagcggcaagacccggaagtacctgccggccatcgtgcgcgaggccatcaagcggcgcctccggaccctgatcctggcccccacgcgcgtggtcgccgcggagatggaggaggccctcaaggggctgcccatccggtaccagaccaccgccaccaagtccgagcacacgggccgcgagatcgtggacctgatgtgccacgccaccttcaccatgcggctcctgagccccgtgcgcgtcccgaactacaacctgatcatcatggacgaggcccacttcaccgaccccgcgtccatcgccgcccgggggtacatcagcacgcgcgtgggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcacggacttcgccgggaagaccgtgtggttcgtccccagcatcaaggccggcaacgacatcgccaactgcctccgcaagaacgggaagaaggtgatccagctgtcccggaagaccttcgacaccgagtaccagaagacgaagctgaacgactgggacttcgtggtcaccaccgacatcagcgagatgggcgccaacttcaaggcggaccgcgtgatcgacccgcggcgctgcctcaagcccgtgatcctgaccgacggccccgagcgggtcatcctggccgggcccatgccggtgacggccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagaccttcgtcgagctgatgcggcgcggggacctccccgtgtggctggcccacaaggtcgccagcgagggcatcaagtacacggaccggaagtggtgcttcgacgggcagcgcaacaaccagatcctggaggagaacatggacgtggagatctggaccaaggagggcgagaagaagaagctccggccccgctggctggacgcccggacctactccgacccgctggcgctcaaggagttcaaggacttcgccgccggccgcaagagcatcgccctggacctggtgaccgagatcgggcgcgtcccctcccacctcgcccaccggacgcgcaacgcgctggacaacctggtgatgctccacaccagcgagcacggcgggcgggcctaccgccacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcggacgccccaggacaaccagctggcctacgtcgtgatcgggatcctcaccctggccgcgatcatcgccgccaacgagatgggcctgctcgagacgaccaagcgcgacctgggcatgtccaaggagccgggggtggtcagccccacctcctacctggacgtggacctccaccccgccagcgcgtggaccctgtacgccgtggccacgaccgtcatcacccccatgctgcggcacaccatcgagaactccacggccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacccactacgccatcatcggccccggcctccaggccaaggccacgcgcgaggcccagaagcggaccgcggccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcgcacgagctgggccctctgcgaggcgctgaccctggccaccggccccatcaccacgctctgggagggctcccccgggaagttctggaacaccaccatcgccgtcagcatggccaacatcttccggggctcctacctggccggggcgggcctggccttcagcatcatgaagtccgtggggaccggcaagcgcggcacggggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagaccacgcaccacgccgtcagccgcggcaccgccaagctgcagtggttcgtggagcggaacatggtgatcccggaggggcgcgtcatcgacctcggctgcgggcggggcgggtggtcctactactgcgcgggcctgaagaaggtgaccgaggtgcgcggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcaccatgacgcaccgccggccgaccatcgagaaggacgtcgacctcggcgccggcacccgccacgtgaacgccgagcccgagacccccaacatggacgtgatcggggagcggatcaagcgcatcaaggaggagcacaactccacgtggcactacgacgacgagaacccgtacaagacctgggcctaccacggcagctacgaggtcaaggcgaccgggtccgccagctccatgatcaacggcgtggtcaagctgctgaccaagccctgggacgtggtgcccatggtcacgcagatggccatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgcggccatgggcgccgtgttcacggaggagaaccagtgggacagcgccaaggccgcggtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgcgatgtacgccgacgacaccgccgggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatctcccgcaaggaccagcggggcagcggccaggtgggcacgtacgggctgaacaccttcaccaacatggaggcgcagctcatccgccagatggagggcgagggggtcctgtccaaggccgacctggagaacccccacctcccggagaagaagatcacccagtggctggagacgaagggcgtggagcggctgcgccggatggccatcagcggcgacgactgcgtggtcaagcccatcgacgaccgcttcgccaacgccctcctggcgctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtgcccgtccactgggtgccgaccagccggaccacgtggtccatccacgcgcaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgaccagccgcgccacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10127 - RNA, 9873 nt, synthetic construct
  misc_feature 1..9873: note = derived and/or modified CDS sequence (opt1) from DENV-3__EU529692__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcggggtgatcaccctctacctgggcgccgtggtccaggcggacatggggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagatccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggacctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgacaagatggggatgggcgtgacctacctcgccctgatcgcgacgttcaagatccagcccttcctggccctcgggttcttcctgcggaagctgaccagccgcgagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatgttcaccctgaccgtcgcctggcggaccgcgacgctgatcctcgccggggtgagcctgctgccggtctgccagtccagctccatgcgcaagaccgactggctccccatggccgtggccgccatgggcgtgccgcccctcccgctgttcatcttcagcctcaaggacaccctgaagcggcgctcctggcccctgaacgagggggtcatggcggtgggcctcgtgagcatcctggcctccagcctgctccgcaacgacgtccccatggccggccccctggtggccgggggcctgctcatcgcctgctacgtgatcaccgggacgtccgcggacctgaccgtcgagaaggccgccgacatcacctgggaggaggaggccgagcagaccggcgtgagccacaacctgatgatcacggtggacgacgacgggaccatgcggatcaaggacgacgagaccgagaacatcctcaccgtcctgctgaagaccgccctcctgatcgtgtccggcgtgttcccgtacagcatccccgcgacgctgctcgtctggcacacctggcagaagcagacccagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacctacaacgggaagcggctggagcccaactgggcctccgtgaagaaggacctgatcagctacggcgggggctggcgcctctccgcgcagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgggagggcaaggtggtcgggctgtacggcaacggggtggtgaccaagaacggcgggtacgtctccggcatcgcccagaccaacgcggagccggacggccccacgcccgagctggaggaggagatgttcaagaagcgcaacctcaccatcatggacctgcaccccgggagcggcaagacccggaagtacctgccggccgtggtgcgcgaggccatcaagcggcgcctccggaccctgatcctggcccccacgcgcgtcgtggccgcggagatggaggaggccctcaaggggctgcccatccggtaccagaccaccgccaccaagtccgagcacacgggccgcgagatcgtggacctgatgtgccacgccaccttcaccatgcggctcctgagccccgtccgcgtgccgaactacaacctgatcatcatggacgaggcccacttcaccgaccccgcgtccatcgccgcccgggggtacatcagcacgcgcgtgggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcacggacttcgccgggaagaccgtctggttcgtgcccagcatcaaggccggcaacgacatcgccaactgcctccgcaagaacgggaagaaggtgatccagctgtcccggaagaccttcgacaccgagtaccagaagacgaagctgaacgactgggacttcgtcgtgaccaccgacatcagcgagatgggcgccaacttcaaggcggaccgcgtgatcgacccgcggcgctgcctcaagcccgtcatcctgaccgacggccccgagcgggtgatcctggccgggcccatgccggtgacggccgcctccgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacacggaccggaagtggtgcttcgacgggcagcgcaacaaccagatcctggaggagaacatggacgtggagatctggaccaaggagggcgagaagaagaagctccggccccgctggctggacgcccggacctactccgacccgctggcgctcaaggagttcaaggacttcgccgccggccgcaagagcatcgccctggacctggtcaccgagatcgggcgcgtgccctcccacctcgcccaccggacgcgcaacgcgctggacaacctggtgatgctccacaccagcgagcacggcgggcgggcctaccgccacgccgtcgaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcggacgccccaggacaaccagctggcctacgtggtgatcgggatcctcaccctggccgcgatcatcgccgccaacgagatgggcctgctcgagacgaccaagcgcgacctgggcatgtccaaggagccgggggtcgtgagccccacctcctacctggacgtggacctccaccccgccagcgcgtggaccctgtacgccgtcgccacgaccgtgatcacccccatgctgcggcacaccatcgagaactccacggccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacccactacgccatcatcggccccggcctccaggccaaggccacgcgcgaggcccagaagcggaccgcggccgggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcacgagctgggccctctgcgaggcgctgaccctggccaccggccccatcaccacgctctgggagggctcccccgggaagttctggaacaccaccatcgccgtgagcatggccaacatcttccggggctcctacctggccggggcgggcctggccttcagcatcatgaagtccgtggggaccggcaagcgcggcacggggagccagggcgagaccctcggggagaagtggaagaagaagctgaaccagctgagccggaaggagttcgacctctacaagaagtccggcatcaccgaggtcgaccgcaccgaggccaaggaggggctgaagcggggcgagaccacgcaccacgccgtgagccgcggcaccgccaagctgcagtggttcgtggagcggaacatggtcatcccggaggggcgcgtgatcgacctcggctgcgggcggggcgggtggtcctactactgcgcgggcctgaagaaggtgaccgaggtccgcggctacaccaagggcgggcccgggcacgaggagcccgtgcccatgagcacgtacggctggaacatcgtgaagctgatgtccgggaaggacgtcttctacctcccgcccgagaagtgcgacaccctgctgtgcgacatcggcgagagctcccccagccccaccgtggaggagtcccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgagccggaactccacccacgagatgtactggatcagcaacggcaccgggaacatcgtggcctccgtgaacatggtcagccgcctcctgctgaaccggttcaccatgacgcaccgccggccgaccatcgagaaggacgtggacctcggcgccggcacccgccacgtgaacgccgagcccgagacccccaacatggacgtcatcggggagcggatcaagcgcatcaaggaggagcacaactccacgtggcactacgacgacgagaacccgtacaagacctgggcctaccacggcagctacgaggtgaaggcgaccgggtccgccagctccatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgggaggagttcaccaagaaggtgcgcaccaacgcggccatgggcgccgtcttcacggaggagaaccagtgggacagcgccaaggccgcggtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgcgatgtacgccgacgacaccgccgggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatctcccgcaaggaccagcggggcagcgggcaggtcggcacgtacgggctgaacaccttcaccaacatggaggtgcagctcatccgccagatggagggcgagggggtgctgtccaaggcggacctggagaacccccacctcccggagaagaagatcacccagtggctggagacgaagggcgtcgagcggctgcgccggatggccatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcgcggatctcccagggggccggctggagcctccgcgagaccgcctgcctgggcaaggcctacgcgcagatgtggtccctgatgtacttccaccgccgggacctccgcctggccagcaacgccatctgctccgccgtgcccgtgcactgggtcccgaccagccggaccacgtggtccatccacgcccaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgaccagccgcgcgacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10128 - RNA, 9873 nt, synthetic construct
  misc_feature 1..9873: note = derived and/or modified CDS sequence (opt1) from DENV-3__EU482558__SS-prME
  source 1..9873: mol_type = other RNA
accagcctctgcctcatgatgatcctgcccgcggcgctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacacgtccgaccggatggggatgggcgtgacctacctcgccctgatcgccaccttcaagatccagcccttcctggccctcgggttcttcctgcgcaagctgaccagccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgctccaacaccatcttcaccctgacggtcgcctggcgcaccgccaccctgatcctcgccggggtgagcctgctgccggtctgccagtccagctccatgcggaagaccgactggctccccatgacggtggcggccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggccggccccctggtggccggcgggctgctcatcgcctgctacgtgatcaccgggacctccgccgacctgacggtcgagaaggccgccgacgtgacctgggaggaggaggcggagcagaccggggtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgccatcgcgctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggccatcaagcgccggctccgcaccctgatcctggcgcccacccgggtggtcgccgccgagatggaggaggccctcaaggggctgcccatccgctaccagacgaccgccaccaagtccgagcacaccggccgggagatcgtggacctgatgtgccacgcgacgttcaccatgcgcctcctgagccccgtgcgggtcccgaactacaacctgatcatcatggacgaggcccacttcaccgaccccgcctccatcgccgcccgcgggtacatcagcacccgggtgggcatgggcgaggcggccgccatcttcatgacggccacgccgcccgggaccgcggacgccttcccgcagtccaacgcccccatccaggacgaggagcgcgacatccccgagcgcagctggaactccggcaacgagtggatcaccgacttcgccgggaagacggtgtggttcgtccccagcatcaaggccggcaacgacatcgcgaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgccgcgtccgccgcccagcggcgcggccgggtggggcgcaacccccagaaggagaacgaccagtacatcttcaccggccagcccctcaacaacgacgaggaccacgcccactggacggaggccaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcccacaaggtcgcgagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgccggccgcaagagcatcgcgctggacctggtgaccgagatcgggcgggtcccctcccacctcgcccaccgcacccggaacgccctggacaacctggtgatgctccacacgagcgagcacggcgggaaggcctaccgccacgccgtggaggagctgcccgagaccatggagaccctgctcctgctgggcctcatgatcctgctgaccgggggcgcgatgctgttcctgatcagcggcaaggggatcggcaagacgtccatcgggctgatctgcgtcatcgccagctccggcatgctctggatggccgagatcccgctgcagtggatcgccagcgccatcgtgctggagttcttcatgatggtgctcctgatccccgagcccgagaagcagcggacgccccaggacaaccagctggcgtacgtcgtgatcgggatcctcaccctggccgccatcatcgccgccaacgagatgggcctgctcgagaccacgaagcgcgacctgggcatgtccaaggagccgggggtggtcagccccacctcctacctggacgtggacctccaccccgcgagcgcctggaccctgtacgccgtggccaccacggtcatcacccccatgctgcggcacaccatcgagaactccaccgcgaacgtgagcctcgccgccatcgccaaccaggccgtggtcctgatgggcctggacaaggggtggccgatctccaagatggacctcggcgtgcccctgctggcgctcgggtgctacagccaggtgaaccccctgacgctgaccgccgccgtcctcctgctgatcacccactacgccatcatcggccccggcctccaggccaaggcgacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcgcaccagctgggcgctctgcgaggccctgacgctggccaccggccccatcaccaccctctgggagggctcccccgggaagttctggaacacgaccatcgccgtcagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgcggtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgccggcacccgccacgtgaacgcggagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggccatgaccgacaccacgcccttcgggcagcagcgggtgttcaaggagaaggtggacacccgcaccccgcggagcatgcccggcacccgccgggtcatgggcatcacggcggagtggctctggcgcaccctggggcggaacaagaagccccgcctgtgcacccgggaggagttcaccaagaaggtgcgcacgaacgccgccatgggcgccgtgttcaccgaggagaaccagtgggactccgcgaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgccgggtgggacacccggatcacggaggacgacctgcacaacgaggagaagatcacccagcagatggacccggagcaccgccagctcgcgaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggccgacctggagaacccccacctcccggagaagaagatcacgcagtggctggagaccaagggcgtggagcggctgaagcgcatggccatctccggcgacgactgcgtggtcaagcccatcgacgaccggttcgcgaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggccggctggtccctccgggagaccgcgtgcctgggcaaggcctacgcccagatgtggagcctgatgtacttccaccgccgcgacctccggctggcctccaacgcgatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgtcccgggccacctgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10129 - RNA, 9873 nt, synthetic construct
  misc_feature 1..9873: note = derived and/or modified CDS sequence (opt1) from DENV-3__EU482563__SS-prME
  source 1..9873: mol_type = other RNA
accagcctgtgcctcatgatgatcctgcccgccgccctggccttccacctcaccagccgcgacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcggcaggtcgagaaggtcgagacctgggcgctgcgccacccggggttcacgatcctcgccctgttcctggcccactacatcggcacctccctcacccagaaggtggtgatcttcgtcctgctgatgctcgtgacccccagcatgacgatgcggtgcgtgggggtcggcaaccgcgacttcgtggagggcctgtccggggccacctgggtggacgtcgtgctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtcctgccggaggagcaggaccagaactacgtgtgcaagcacacgtacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcaccgtgcacacgggggaccagcaccaggtcggcaacgagacccagggggtgaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtcaccttcaagaacgcccacgcgaagaagcaggaggtggtggtcctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtgctgaagaaggaggtgtccgagacgcagcacgggaccatcctcatcaaggtcgagtacaagggcgaggacgccccgtgcaagatccccttcagcaccgaggacgggcagggcaaggcccacaacggccgcctgatcaccgccaaccccgtggtgacgaagaaggaggagcccgtcaacatcgaggcggagccgcccttcggggagagcaacatcgtgatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgcggtggtccaggccgacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgcgggcgcctgggagaacggggtgtgcggcatccgcagcacgacccggatggagaacctgctgtggaagcaggtcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgcggtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgcgggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgcgctgatcgccaccttcaagatccagcccttcctggccctcgggttcttcctgcgcaagctgaccagccgggagaacctcctgctgggcgtcggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtggcgtggcgcacggccaccctgatcctcgccggggtcagcctgctgccggtgtgccagtccagctccatgcggaagtccgactggctccccatgaccgtggccgccatgggcgtgccgcccctcccgctgttcatcttctccctcaaggacaccctgaagcgccgcagctggcccctgaacgagggggtgatggcggtgggcctcgtctccatcctggccagctccctgctccggaacgacgtgcccatggccggccccctggtggccgggggcctgctcatcgcctgctacgtcatcacggggaccagcgcggacctgaccgtggagaaggccgccgacgtgacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcatcttcccgtactccatccccgcgaccctgctcgtgtggcacacctggcagaagcagacccggcgcagcggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggccagcgtgaagaaggacctgatctcctacggcgggggctggcgcctcagcgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggctcccccatcatcaaccgggagggcaaggtcgtggggctgtacggcaacggggtggtcaccaagaacggcgggtacgtgagcggcatcgcccagacgaacgcggagccggacggccccacccccgagctggaggaggagatgttcaagaagcgcaacctcaccatcatggacctgcaccccgggtccggcaagacccggaagtacctgccggccatcgtgcgcgaggccatcaagcggcgcctccggacgctgatcctggcccccacccgcgtcgtggccgcggagatggaggaggccctcaaggggctgcccatccggtaccagaccaccgccaccaagagcgagcacaccggccgcgagatcgtggacctgatgtgccacgccaccttcaccatgcggctcctgtcccccgtccgcgtgccgaactacaacctgatcatcatggacgaggcccacttcacggaccccgcgagcatcgccgcccgggggtacatctccacccgcgtgggcatgggcgaggccgcggccatcttcatgaccgccacgccgcccgggacggccgacgccttcccgcagagcaacgcgcccatccaggacgaggagcgcgacatccccgagcggtcctggaacagcggcaacgagtggatcaccgacttcgccgggaagaccgtctggttcgtgccctccatcaaggccggcaacgacatcgccaactgcctccgcaagaacgggaagaaggtgatccagctgagccggaagaccttcgacacggagtaccagaagaccaagctgaacgactgggacttcgtcgtgaccaccgacatctccgagatgggcgccaacttcaaggcggaccgcgtgatcgacccgcggcgctgcctcaagcccgtcatcctgacggacggccccgagcgggtgatcctggccgggcccatgccggtgaccgccgccagcgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctacagcgacccgctggcgctcaaggagttcaaggacttcgccgccggccggaagtccatcgccctggacctggtcacggagatcgggcgcgtgcccagccacctcgcccaccggacccgcaacgcgctggacaacctggtgatgctccacaccagcgagcacggcgggaaggcctaccggcacgccgtcgaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggcggagatcccgctgcagtggatcgcctccgccatcgtgctggagttcttcatgatggtcctcctgatccccgagcccgagaagcagcgcacgccccaggacaaccagctggcctacgtggtgatcgggatcctcacgctggccgcgatcatcgccgccaacgagatgggcctgctcgagaccaccaagcgggacctgggcatgagcaaggagccgggggtcgtgtcccccaccagctacctggacgtggacctccaccccgcctccgcgtggacgctgtacgccgtcgccaccaccgtgatcacccccatgctgcgccacacgatcgagaacagcaccgccaacgtgtccctcgccgcgatcgccaaccaggccgtcgtgctgatgggcctggacaaggggtggccgatcagcaagatggacctcggcgtgcccctgctggccctcgggtgctactcccaggtcaaccccctgaccctgaccgccgcggtgctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtcatctacgacagcaagttcgagaagcagctgggccaggtgatgctcctggtgctgtgcgccgtccagctcctgctgatgcggacctcctgggccctctgcgaggcgctgaccctggccaccggccccatcacgaccctctgggagggcagccccgggaagttctggaacaccaccatcgccgtgtccatggccaacatcttccgcggcagctacctggccggggcgggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtcgaccggaccgaggccaaggaggggctgaagcgcggcgagatcacgcaccacgccgtgtcccggggcagcgccaagctgcagtggttcgtggagcgcaacatggtcatcccggaggggcgggtgatcgacctcggctgcgggcgcggcgggtggtcctactactgcgcgggcctgaagaaggtgaccgaggtccggggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacgcacgagatgtactggatcagcaacggcaccgggaacatcgtggcctccgtgaacatggtcagccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaactccacctggcactacgacgacgagaacccgtacaagacgtgggcctaccacggcagctacgaggtgaaggcgaccgggtccgccagcagcatgatcaacggcgtcgtgaagctgctgaccaagccctgggacgtggtccccatggtgacccagatggccatgacggacaccacccccttcgggcagcagcgcgtgttcaaggagaaggtcgacacccggacgccgcgctccatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggacagcgccaaggccgcggtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatctcccggaaggaccagcgcggcagcgggcaggtcggcacctacgggctgaacacgttcaccaacatggaggcgcagctcatccggcagatggagggcgagggggtgctgaccaaggccgacctggagaacccccacctctccgagaagaagatcacccagtggctggagacgaagggcgtggagcgcctgaagcggatggccatcagcggcgacgactgcgtcgtgaagccgatcgacgaccgcttcgccaacgccctcctggcgctgaacgacatggggaaggtgcggaaggacatcccccagtggcagccctccaagggctggcacgactggcagcaggtccccttctgcagccaccacttccacgagctcatcatgaaggacgggcgcaagctggtggtgccgtgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtccccgtgcactgggtgcccaccagccggaccacgtggagcatccacgcgcaccaccagtggatgaccaccgaggacatgctgaccgtctggaaccgcgtgtggatcgaggacaacccgtggatggaggacaagacgcccgtgaccacctgggagaacgtcccctacctcgggaagcgggaggaccagtggtgcggctccctgatcgggctgaccagccgcgccacgtgggcccagaacatccccaccgccatccagcaggtccggtccctcatcggcaacgaggagttcctggactacatgccgagcatgaagcgcttccggaaggaggaggagtccgagggggccatctggtga

SEQ ID NO: 10130 - RNA, 9873 nt, synthetic construct
  misc_feature 1..9873: note = derived and/or modified CDS sequence (opt1) from DENV-3__EU529696__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcggggtgatcaccctctacctgggcgccgtggtccaggcggacatggggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagatccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggacctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgacaagatggggatgggcgtgacctacctcgccctgatcgcgacgttcaagatccagcccttcctggccctcgggttcttcctgcggaagctgaccagccgcgagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatgttcaccctgaccgtcgcctggcggaccgcgacgctgatcctcgccggggtgagcctgctgccggtctgccagtccagctccatgcgcaagaccgactggctccccatggccgtggccgccatgggcgtgccgcccctcccgctgttcatcttcagcctcaaggacaccctgaagcggcgctcctggcccctgaacgagggggtcatggcggtgggcctcgtgagcatcctggcctccagcctgctccgcaacgacgtccccatggccggccccctggtggccgggggcctgctcatcgcctgctacgtgatcaccgggacgtccgcggacctgaccgtcgagaaggccgccgacatcacctgggaggaggaggccgagcagaccggcgtgagccacaacctgatgatcacggtggacgacgacgggaccatgcggatcaaggacgacgagaccgagaacatcctcaccgtcctgctgaagaccgccctcctgatcgtgtccggcgtgttcccgtacagcatccccgcgacgctgctcgtctggcacacctggcagaagcagacccagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacctacaacgggaagcggctggagcccaactgggcctccgtgaagaaggacctgatcagctacggcgggggctggcgcctctccgcgcagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgggagggcaaggtggtcgggctgtacggcaacggggtggtgaccaagaacggcgggtacgtctccggcatcgcccagaccaacgcggagccggacggccccacgcccgagctggaggaggagatgttcaagaagcgcaacctcaccatcatggacctgcaccccgggagcggcaagacccggaagtacctgccggccgtggtgcgcgaggccatcaagcggcgcctccggaccctgatcctggcccccacgcgcgtcgtggccgcggagatggaggaggccctcaaggggctgcccatccggtaccagaccaccgccaccaagtccgagcacacgggccgcgagatcgtggacctgatgtgccacgccaccttcaccatgcggctcctgagccccgtccgcgtgccgaactacaacctgatcatcatggacgaggcccacttcaccgaccccgcgtccatcgccgcccgggggtacatcagcacgcgcgtgggcatgggcgaggccgcggccatcttcatgaccgccacgccgcccgggaccgccgacgccttcccgcagtccaacgcgcccatccaggacgaggagcgggacatccccgagcgcagctggaactccggcaacgagtggatcacggacttcgccgggaagaccgtctggttcgtgcccagcatcaaggccggcaacgacatcgccaactgcctccgcaagaacgggaagaaggtgatccagctgtcccggaagaccttcgacaccgagtaccagaagacgaagctgaacgactgggacttcgtcgtgaccaccgacatcagcgagatgggcgccaacttcaaggcggaccgcgtgatcgacccgcggcgctgcctcaagcccgtcatcctgaccgacggccccgagcgggtgatcctggccgggcccatgccggtgacggccgcctccgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacacggaccggaagtggtgcttcgacgggcagcgcaacaaccagatcctggaggagaacatggacgtggagatctggaccaaggagggcgagaagaagaagctccggccccgctggctggacgcccggacctactccgacccgctggcgctcaaggagttcaaggacttcgccgccggccgcaagagcatcgccctggacctggtcaccgagatcgggcgcgtgccctcccacctcgcccaccggacgcgcaacgcgctggacaacctggtgatgctccacaccagcgagcacggcgggcgggcctaccgccacgccgtcgaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcggacgccccaggacaaccagctggcctacgtggtgatcgggatcctcaccctggccgcgatcatcgccgccaacgagatgggcctgctcgagacgaccaagcgcgacctgggcatgtccaaggagccgggggtcgtgagccccacctcctacctggacgtggacctccaccccgccagcgcgtggaccctgtacgccgtcgccacgaccgtgatcacccccatgctgcggcacaccatcgagaactccacggccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacccactacgccatcatcggccccggcctccaggccaaggccacgcgcgaggcccagaagcggaccgcggccgggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcacgagctgggccctctgcgaggcgctgaccctggccaccggccccatcaccacgctctgggagggctcccccgggaagttctggaacaccaccatcgccgtgagcatggccaacatcttccggggctcctacctggccggggcgggcctggccttcagcatcatgaagtccgtggggaccggcaagcgcggcacggggagccagggcgagaccctcggggagaagtggaagaagaagctgaaccagctgagccggaaggagttcgacctctacaagaagtccggcatcaccgaggtcgaccgcaccgaggccaaggaggggctgaagcggggcgagaccacgcaccacgccgtgagccgcggcaccgccaagctgcagtggttcgtggagcggaacatggtcatcccggaggggcgcgtgatcgacctcggctgcgggcggggcgggtggtcctactactgcgcgggcctgaagaaggtgaccgaggtccgcggctacaccaagggcgggcccgggcacgaggagcccgtgcccatgagcacgtacggctggaacatcgtgaagctgatgtccgggaaggacgtcttctacctcccgcccgagaagtgcgacaccctgctgtgcgacatcggcgagagctcccccagccccaccgtggaggagtcccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgagccggaactccacccacgagatgtactggatcagcaacggcaccgggaacatcgtggcctccgtgaacatggtcagccgcctcctgctgaaccggttcaccatgacgcaccgccggccgaccatcgagaaggacgtggacctcggcgccggcacccgccacgtgaacgccgagcccgagacccccaacatggacgtcatcggggagcggatcaagcgcatcaaggaggagcacaactccacgtggcactacgacgacgagaacccgtacaagacctgggcctaccacggcagctacgaggtgaaggcgaccgggtccgccagctccatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgggaggagttcaccaagaaggtgcgcaccaacgcggccatgggcgccgtcttcacggaggagaaccagtgggacagcgccaaggccgcggtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgcgatgtacgccgacgacaccgccgggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatctcccgcaaggaccagcggggcagcgggcaggtcggcacgtacgggctgaacaccttcaccaacatggaggcgcagctcatccgccagatggagggcgagggggtgctgtccaaggccgacctggagaacccccacctcccggagaagaagatcacccagtggctggagacgaagggcgtggagcggctgcgccggatggccatcagcggcgacgactgcgtcgtgaagcccatcgacgaccgcttcgccaacgccctcctggcgctgaacgacatggggaaggtgcggaaggacatcccccagtggcagccctccaagggctggcacgactggcagcaggtcccgttctgcagccaccacttccacgagctcatcatgaaggacgggcgcaagctggtggtgccctgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtccccgtgcactgggtgccgaccagccggaccacgtggtccatccacgcgcaccaccagtggatgaccaccgaggacatgctgaccgtctggaaccgcgtgtggatcgaggacaacccctggatggaggacaagacgcccgtgaccacctgggagaacgtcccctacctcgggaagcgggaggaccagtggtgcggcagcctgatcgggctgaccagccgcgccacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10131 - RNA, 9873 nt, synthetic construct
  misc_feature 1..9873: note = derived and/or modified CDS sequence (opt1) from DENV-3__EU529697__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcgtcctgctgatgctcgtgacccccagcatgacgatgcggtgcgtgggggtcggcaaccgcgacttcgtggagggcctgtccggggccacctgggtggacgtcgtgctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgccctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgcggagatcacgccccaggccagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcgcacgccaagaagcaggaggtcgtggtgctggggtcccaggagggcgccatgcacaccgccctcaccggggccacggagatccagaacagcggcgggacctccatcttcgcgggccacctgaagtgccggctgaagatggacaagctcgagctgaagggcatgagctacgccatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgcgaaccccgtcgtgacgaagaaggaggagcccgtgaacatcgaggccgagccgcccttcggggagagcaacatcgtcatcggcatcggggacaacgccctgaagatcaactggtacaagaagggctccagcatcgggaagatgttcgaggccaccgcccggggcgcgcgccggatggccatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgcgatcgggatcatcaccctctacctgggcgccgtggtgcaggccgacaccgggtgcgtcatcaactggaagggcaaggagctgaagtgcggcagcgggatcttcgtgacgaacgaggtgcacacctggaccgagcagtacaagttccaggccgactcccccaagcgcctcgccaccgcgatcgccggcgcctgggagaacggggtctgcggcatccgcagcacgacccggatggagaacctgctgtggaagcaggtcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggcgaagatcgtcaccgccgagacccagaacagctccttcatcatcgacggccccaacacgcccgagtgccccagcgcctcccgggcctggaacgtgtgggaggtggaggactacgggttcggcgtcttcaccaccaacatctggctcaagctgcgcgaggtgtacacccagctgtgcgaccaccggctcatgagcgccgcggtgaaggacgagcgcgccgtccacgccgacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgcggggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcccacaccctgatcatgatcggcagcaacgcgtccgaccggatggggatgggcgtgacgcacctcgccctgatcgccaccttcaagatccagcccttcctggccctcgggttcttcctgcgcaagctgaccagccgggagaacctcctgctgggcgtgggcctcgcgatggccaccacgctgcagctgcccgaggacatcgagcagatggccaacgggatcgccctcggcctgatggccctgaagctcatcacccagttcgagacctaccagctgtggaccgcgctgatcagcctcacgtgctccaacaccatcttcaccctgaccgtcgcctggcgcacggccaccctgatcctcgccggggtgagcctgctgccggtctgccagtccagctccatgcggaagtccgactggctccccatgaccgtggccgcgatgggcgtgccgcccctcccgctgttcatcttctccctcaaggacaccctgaagcgccgcagctggcccctgaacgagggggtcatggccgtgggcctcgtgtccatcctggccagctccctgctccggaacgacgtccccatggccggccccctggtggccgggggcctgctcatcgcgtgctacgtgatcacggggaccagcgccgacctgaccgtcgagaaggccgccgacgtgacctgggaggaggaggccgagcagacgggcgtgtcccacaacctgatgatcaccgtcgacgacgacgggaccatgcgcatcaaggacgacgagaccgagaacatcctcaccgtgctgctgaagacggcgctcctgatcgtgagcggcatcttcccgtactccatccccgccaccctgctcgtctggcacacctggcagaagcagacccggcgcagcggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcgagcgtgaagaaggacctgatctcctacggcgggggctggcgcctcagcgcccagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggctcccccatcatcaaccgggagggcaaggtggtcgggctgtacggcaacggggtggtgaccaagaacggcgggtacgtcagcggcatcgcgcagacgaacgccgagccggacggccccacccccgagctggaggaggagatgttcaagaagcgcaacctcaccatcatggacctgcaccccgggtccggcaagacccggaagtacctgccggccatcgtgcgcgaggccatcaagcggcgcctccggacgctgatcctggcccccacccgcgtggtcgcggccgagatggaggaggccctcaaggggctgcccatccggtaccagaccaccgccaccaagagcgagcacaccggccgcgagatcgtggacctgatgtgccacgccaccttcaccatgcggctcctgtcccccgtgcgcgtcccgaactacaacctgatcatcatggacgaggcgcacttcacggaccccgccagcatcgccgcccgggggtacatctccacccgcgtgggcatgggcgaggcggccgccatcttcatgaccgccacgccgcccgggacggccgacgcgttcccgcagagcaacgcccccatccaggacgaggagcgcgacatccccgagcggtcctggaacagcggcaacgagtggatcaccgacttcgccgggaagaccgtgtggttcgtcccctccatcaaggccggcaacgacatcgccaactgcctccgcaagaacgggaagaaggtgatccagctgagccggaagaccttcgacacggagtaccagaagaccaagctgaacgactgggacttcgtggtcaccaccgacatctccgagatgggcgcgaacttcaaggccgaccgcgtgatcgacccgcggcgctgcctcaagcccgtgatcctgacggacggccccgagcgggtcatcctggccgggcccatgccggtgaccgccgccagcgcggcccagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagagccgcaagacgttcgtcgagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcgcgcacctacagcgacccgctggccctcaaggagttcaaggacttcgccgccggccggaagtccatcgccctggacctggtgacggagatcgggcgcgtccccagccacctcgcgcaccggacccgcaacgccctggacaacctggtgatgctccacaccagcgagcacggcgggaaggcctaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtcatcgcgtccagcggcatgctctggatggccgagatcccgctgcagtggatcgcctccgccatcgtgctggagttcttcatgatggtgctcctgatccccgagcccgagaagcagcgcacgccccaggacaaccagctggcctacgtcgtgatcgggatcctcacgctggcggccatcatcgccgccaacgagatgggcctgctcgagaccaccaagcgggacctgggcatgagcaaggagccgggggtggtctcccccaccagctacctggacgtggacctccaccccgcgtccgcctggacgctgtacgccgtggccaccaccgtcatcacccccatgctgcgccacacgatcgagaacagcaccgccaacgtgtccctcgcggccatcgccaaccaggccgtggtcctgatgggcctgaacaaggggtggccgatcagcaagatggacctcggcgtgcccctgctggccctcgggtgctactcccaggtgaaccccctgaccctgaccgcggccgtcctcctgctgatcacgcactacgccatcatcggccccggcctccaggccaaggccacccgggaggcgcagaagcgcaccgccgccgggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcggacctcctgggcgctctgcgaggccctgaccctggccaccggccccatcacgaccctctgggagggcagccccgggaagttctggaacaccaccatcgccgtctccatggccaacatcttccgcggcagctacctggcgggggccggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgccgtctcccggggcagcgcgaagctgcagtggttcgtggagcgcaacatggtgatcccggaggggcgggtcatcgacctcggctgcgggcgcggcgggtggtcctactactgcgccggcctgaagaaggtgaccgaggtgcggggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtcgcctccgtgaacatggtgagccggctcctgctgaaccgcttcaccatgacccaccggcgcccgacgatcgagaaggacgtcgacctcggcgccggcacccggcacgtgaacgccgagcccgagacccccaacatggacgtgatcggggagcgcatcaagcggatcaaggaggagcacaactccacctggcactacgacgacgagaacccgtacaagacgtgggcgtaccacggcagctacgaggtcaaggccaccgggtccgccagcagcatgatcaacggcgtggtcaagctgctgaccaagccctgggacgtggtgcccatggtcacccagatggccatgacggacaccacccccttcgggcagcagcgcgtgttcaaggagaaggtggacacccggacgccgcgctccatgcccggcacccggcgcgtcatgggcatcaccgcggagtggctctggcggaccctggggcgcaacaagaagccccggctgtgcacgcgcgaggagttcaccaagaaggtgcgcaccaacgccgccatgggcgccgtgttcaccgaggagaaccagtgggacagcgccaaggcggccgtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggcgctcgggttcctgaacgaggaccactggttctcccgcgagaacagctactccggcgtcgagggggagggcctgcacaagctcggctacatcctgcgggacatcagcaagatccccgggggcgccatgtacgccgacgacacggccgggtgggacacccgcatcaccgaggacgacctgcacaacgaggagaagatcacccagcagatggacccggagcaccggcagctcgccaacgcgatcttcaagctgacgtaccagaacaaggtggtgaaggtccagcgccccacccccaccggcaccgtgatggacatcatctcccggaaggaccagcgcggcagcggccaggtgggcacctacgggctgaacacgttcaccaacatggaggcccagctcatccggcagatggagggcgagggggtcctgaccaaggccgacctggagaacccccacctctccgagaagaagatcacccagtggctggagacgaagggcgtggagcgcctgaagcggatggccatcagcggcgacgactgcgtggtcaagccgatcgacgaccgcttcgccaacgcgctcctggccctgaacgacatggggaaggtgcggaaggacatcccccagtggcagccctccaagggctggcacgactggcagcaggtccccttctgcagccaccacttccacgagctcatcatgaaggacgggcgcaagctggtcgtgccgtgccggccccaggacgagctgatcggccgcgcccggatctcccagggggccggctggagcctccgcgagaccgcgtgcctgggcaaggcctacgcccagatgtggtccctgatgtacttccaccgccgggacctccgcctggccagcaacgccatctgctccgcggtgcccgtccactgggtgcccaccagccggaccacgtggagcatccacgcccaccaccagtggatgaccaccgaggacatgctgaccgtgtggaaccgcgtctggatcgaggacaacccgtggatggaggacaagacgcccgtgaccacctgggagaacgtgccctacctcgggaagcgggaggaccagtggtgcggctccctgatcgggctgaccagccgcgccacgtgggcccagaacatccccaccgccatccagcaggtccggtccctcatcggcaacgaggagttcctggactacatgccgagcatgaagcgcttccggaaggaggaggagtccgagggggcgatctggtga

SEQ ID NO: 10132 - RNA, 9873 nt, synthetic construct
  misc_feature 1..9873: note = derived and/or modified CDS sequence (opt1) from DENV-3__EU482564__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcggggtgatcaccctctacctgggcgccgtggtccaggcggacatggggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagatccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggacctggacttcaactactgcgagggcaccacggtcgtgatcaccgagaactgcgggacccgccggcccagcctccgcaccacgaccgtgtccggcaagctgatccacgagtggtgctgccggagctgcaccctgcccccgctccgctacatgggggaggacggctgctggtacgggatggagatccggcccatctccgagaaggaggagaacatggtcaagagcctggtgtccgccggcagcggcaaggtggacaacttcaccatgggggtcctgtgcctcgcgatcctgttcgaggaggtgatgcgcggcaagttcgggaagaagcacatgatcgccggcgtgttcttcacgttcgtcctgctcctgtccgggcagatcacctggcgggacatggcccacaccctgatcatgatcggcagcaacgcctccgacaagatgggcatgggggtgacctacctcgccctgatcgcgacgttcaagatccagcccttcctggccctcggcttcttcctgcgcaagctgaccagccgggagaacctcctgctgggggtgggcctcgccatggccaccaccctgcagctgcccgaggacatcgagcagatggcgaacggcatcgccctcgggctgatggccctgaagctcatcacgcagttcgagacctaccagctgtggaccgccctgatcagcctgacctgctccaacacgatgttcaccctgaccgtcgcctggcgcaccgcgacgctgatcctcgccggcgtgagcctgctgccggtctgccagtccagctccatgcggaagaccgactggctccccatggccgtggccgccatgggggtgccgcccctcccgctgttcatcttcagcctcaaggacaccctgaagcgccgctcctggcccctgaacgagggcgtcatggcggtggggctcgtgagcatcctggcctccagcctgctccggaacgacgtccccatggccggccccctggtggccggcgggctgctcatcgcctgctacgtgatcaccggcacgtccgcggacctgaccgtcgagaaggccgccgacatcacctgggaggaggaggccgagcagaccggggtgagccacaacctgatgatcacggtggacgacgacggcaccatgcgcatcaaggacgacgagaccgagaacatcctcaccgtcctgctgaagaccgccctcctgatcgtgtccggggtgttcccgtacagcatccccgcgacgctgctcgtctggcacacctggcagaagcagacccagcggtccggcgtgctgtgggacgtgcccagcccgcccgagacccagaaggccgagctggaggagggcgtctaccgcatcaagcagcaggggatcttcggcaagacccaggtgggggtgggcgtccagaaggagggggtgttccacaccatgtggcacgtgacccggggcgccgtcctcacctacaacggcaagcgcctggagcccaactgggcctccgtgaagaaggacctgatcagctacgggggcgggtggcggctctccgcgcagtggcagaagggcgaggaggtgcaggtcatcgccgtggagcccgggaagaaccccaagaacttccagacgatgcccggcaccttccagaccaccacgggcgagatcggggccatcgccctggacttcaagcccggcaccagcgggagccccatcatcaaccgcgagggcaaggtggtcggcctgtacgggaacggcgtggtgaccaagaacgggggctacgtctccgggatcgcccagaccaacgcggagccggacggccccacgcccgagctggaggaggagatgttcaagaagcggaacctcaccatcatggacctgcaccccggcagcgggaagacccgcaagtacctgccggccgtggtgcgggaggccatcaagcgccggctccgcaccctgatcctggcccccacgcgggtcgtggccgcggagatggaggaggccctcaagggcctgcccatccgctaccagaccaccgccaccaagtccgagcacacggggcgggagatcgtggacctgatgtgccacgccaccttcaccatgcgcctcctgagccccgtccgggtgccgaactacaacctgatcatcatggacgaggcccacttcaccgaccccgcgtccatcgccgcccgcggctacatcagcacgcgggtggggatgggcgaggccgcggccatcttcatgaccgccacgccgcccggcaccgccgacgccttcccgcagtccaacgcgcccatccaggacgaggagcgcgacatccccgagcgcagctggaactccgggaacgagtggatcacggacttcgccggcaagaccgtctggttcgtgcccagcatcaaggccgggaacgacatcgccaactgcctccggaagaacggcaagaaggtgatccagctgtcccgcaagaccttcgacaccgagtaccagaagacgaagctgaacgactgggacttcgtcgtgaccaccgacatcagcgagatgggggccaacttcaaggcggaccgggtgatcgacccgcgccggtgcctcaagcccgtcatcctgaccgacggccccgagcgcgtgatcctggccggccccatgccggtgacggccgcctccgccgcgcagcggcgcgggcgggtcggccgcaacccccagaaggagaacgaccagtacatcttcaccgggcagcccctcaacaacgacgaggaccacgcccactggaccgaggccaagatgctgctggacaacatcaacacccccgagggcatcatcccggccctcttcgagcccgagcgggagaagtccgcggccatcgacggggagtaccgcctgaagggcgagtcccggaagaccttcgtggagctgatgcgccggggcgacctccccgtctggctggcccacaaggtggccagcgaggggatcaagtacacggaccgcaagtggtgcttcgacggccagcggaacaaccagatcctggaggagaacatggacgtggagatctggaccaaggagggggagaagaagaagctccgcccccggtggctggacgcccgcacctactccgacccgctggcgctcaaggagttcaaggacttcgccgccggccgcaagagcatcgccctggacctggtcaccgagatcggccgggtgccctcccacctcgcccaccgcacgcggaacgcgctggacaacctggtgatgctccacaccagcgagcacgggggccgcgcctaccggcacgccgtcgaggagctgcccgagaccatggagaccctgctcctgctggggctcatgatcctgctgacgggcggggccatgctgttcctgatcagcggcaagggcatcgggaagacctccatcggcctgatctgcgtgatcgccagctccgggatgctctggatggcggagatcccgctgcagtggatcgccagcgccatcgtgctggagttcttcatgatggtcctcctgatccccgagcccgagaagcagcgcacgccccaggacaaccagctggcctacgtggtgatcggcatcctcaccctggccgcgatcatcgccgccaacgagatggggctgctcgagacgaccaagcgggacctgggcatgtccaaggagccgggcgtcgtgagccccacctcctacctggacgtggacctccaccccgccagcgcgtggaccctgtacgccgtcgccacgaccgtgatcacccccatgctgcgccacaccatcgagaactccacggccaacgtgagcctcgccgcgatcgccaaccaggccgtcgtgctgatggggctggacaagggctggccgatctccaagatggacctcggggtgcccctgctggccctcggctgctacagccaggtcaaccccctgaccctgaccgccgcggtgctcctgctgatcacccactacgccatcatcgggcccggcctccaggccaaggccacgcgggaggcccagaagcgcaccgcggccggcatcatgaagaacccgaccgtggacgggatcatgaccatcgacctggaccccgtcatctacgactccaagttcgagaagcagctgggccaggtgatgctcctggtgctgtgcgccgtccagctcctgctgatgcggacgagctgggccctctgcgaggcgctgaccctggccaccgggcccatcaccacgctctgggagggctcccccggcaagttctggaacaccaccatcgccgtgagcatggccaacatcttccgcgggtcctacctggccggcgcggggctggccttcagcatcatgaagtccgtgggcaccgggaagcggggcacgggcagccagggggagaccctcggcgagaagtggaagaagaagctgaaccagctgagccgcaaggagttcgacctctacaagaagtccgggatcaccgaggtcgaccggaccgaggccaaggagggcctgaagcgcggggagaccacgcaccacgccgtgagccggggcaccgccaagctgcagtggttcgtggagcgcaacatggtcatcccggagggccgggtgatcgacctcgggtgcggccgcgggggctggtcctactactgcgcggggctgaagaaggtgaccgaggtccggggctacaccaagggcgggcccggccacgaggagcccgtgcccatgagcacgtacgggtggaacatcgtgaagctgatgtccggcaaggacgtcttctacctcccgcccgagaagtgcgacaccctgctgtgcgacatcggggagagctcccccagccccaccgtggaggagtcccgcaccatccgcgtgctgaagatggtcgagccgtggctcaagaacaaccagttctgcatcaaggtgctgaacccctacatgcccacggtgatcgagcacctggagcggctccagcgcaagcacggcggcatgctggtccggaaccccctgagccgcaactccacccacgagatgtactggatcagcaacgggaccggcaacatcgtggcctccgtgaacatggtcagccggctcctgctgaaccgcttcaccatgacgcaccggcgcccgaccatcgagaaggacgtggacctcggggccggcacccggcacgtgaacgccgagcccgagacccccaacatggacgtcatcggcgagcgcatcaagcggatcaaggaggagcacaactccacgtggcactacgacgacgagaacccgtacaagacctgggcctaccacgggagctacgaggtgaaggcgaccggctccgccagctccatgatcaacggggtcgtgaagctgctgaccaagccctgggacgtggtccccatggtgacgcagatggccatgaccgacaccacccccttcggccagcagcgcgtgttcaaggagaaggtcgacacgcggaccccgcgcagcatgcccgggacccggcgcgtgatgggcatcaccgccgagtggctctggcggacgctgggccgcaacaagaagccccggctgtgcacccgcgaggagttcaccaagaaggtgcgcaccaacgcggccatgggggccgtcttcacggaggagaaccagtgggacagcgccaaggccgcggtggaggacgaggacttctggaagctcgtggaccgggagcgcgagctgcacaagctgggcaagtgcgggtcctgcgtctacaacatgatgggcaagcgggagaagaagctcggggagttcggcaaggccaagggcagccgcgccatctggtacatgtggctgggggcccggtacctggagttcgaggccctcggcttcctgaacgaggaccactggttctcccgcgagaacagctactccggggtggagggcgaggggctgcacaagctcggctacatcctgcgggacatcagcaagatccccggcggggcgatgtacgccgacgacaccgccggctgggacacccgcatcaccgaggacgacctgcacaacgaggagaagatcacgcagcagatggacccggagcaccggcagctcgccaacgccatcttcaagctgacctaccagaacaaggtggtcaaggtgcagcgccccacccccaccgggaccgtgatggacatcatctcccggaaggaccagcgcggcagcggccaggtcgggacgtacggcctgaacaccttcaccaacatggaggcgcagctcatccggcagatggagggggagggcgtgctgtccaaggccgacctggagaacccccacctcccggagaagaagatcacccagtggctggagacgaagggggtggagcgcctgcggcgcatggccatcagcggcgacgactgcgtcgtgaagcccatcgacgaccggttcgccaacgccctcctggcgctgaacgacatgggcaaggtgcgcaaggacatcccccagtggcagccctccaaggggtggcacgactggcagcaggtcccgttctgcagccaccacttccacgagctcatcatgaaggacggccggaagctggtggtgccctgccgcccccaggacgagctgatcgggcgggcccgcatctcccagggcgccgggtggagcctccgcgagaccgcctgcctgggcaaggcgtacgcccagatgtggtccctgatgtacttccaccggcgcgacctccggctggccagcaacgccatctgctccgccgtccccgtgcactgggtgccgaccagccgcaccacgtggtccatccacgcgcaccaccagtggatgaccaccgaggacatgctgaccgtctggaaccgggtgtggatcgaggacaacccctggatggaggacaagacgcccgtgaccacctgggagaacgtcccctacctcggcaagcgcgaggaccagtggtgcgggagcctgatcggcctgaccagccgggccacgtgggcccagaacatcccgaccgccatccagcaggtccgctccctcatcgggaacgaggagttcctggactacatgcccagcatgaagcggttccgcaaggaggaggagtccgagggcgccatctggtga

SEQ ID NO: 10133 - RNA, 9873 nt, synthetic construct
  misc_feature 1..9873: note = derived and/or modified CDS sequence (opt1) from DENV-3__EU529699__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccgtctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtcggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtggcctggcgcaccgccaccctgatcctcgcgggggtcagcctgctgccggtgtgccagtccagctccatgcggaagaccgactggctccccatgacggtggccgccatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgacggtggagaaggccgcggacgtgacctgggaggaggaggccgagcagaccggcgtcagccacaacctgatgatcaccgtggacgacgacgggaccatgcgcatcaaggacgacgagacggagaacatcctcaccgtgctgctgaagaccgccctcctgatcgtctccggcatcttcccgtacagcatccccgccaccctgctcgtgtggcacacgtggcagaagcagacccagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacacgatgtggcacgtcacccggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtcgtggggctgtacggcaacggggtggtcaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtcgtggccgccgagatggaggaggccctcaaggggctgcccatccgctaccagacgaccgcgaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtctggttcgtgcccagcatcaaggcgggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacacgagcgagcacggcgggaaggcctaccgccacgcggtcgaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccacgaagcgcgacctgggcatgtccaaggagccgggggtcgtgagccccacctcctacctggacgtggacctccaccccgccagcgcctggaccctgtacgccgtcgcgaccacggtgatcacccccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgacgctgaccgccgccgtgctcctgctgatcacccactacgccatcatcggccccggcctccaggcgaaggccacccgcgaggcccagaagcggacggccgccgggatcatgaagaacccgaccgtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtcgaccgcaccgaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcacgatgacccaccgccggccgaccatcgagaaggacgtggacctcggcgcgggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtggtccccatggtgacccagatggcgatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgggaggagttcaccaagaaggtgcgcacgaacgccgccatgggcgcggtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatcagccgcaaggaccagcggggctccgggcaggtcggcacctacgggctgaacaccttcaccaacatggaggcccagctcatccgccagatggagggcgagggggtgctgagcaaggccgacctggagaacccccacctcccggagaagaagatcacgcagtggctggagaccaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggagaacgtcccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10134 - RNA, 9873 nt, synthetic construct
  misc_feature 1..9873: note = derived and/or modified CDS sequence (opt1) from DENV-3__EU482566__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcacgctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgaagggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgttcttcaccttcgtcctgctcctgtccggccagatcacctggcgggacatggcccacacgctgatcatgatcggcagcaacgcctccgaccgcatggggatgggcgtgacctacctcgccctgatcgccaccttcaagatccagcccttcctggcgctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcggaccgccaccctgatcctcgcgggggtgagcctgctgccggtctgccagtccagctccatgcgcaagaccgactggctccccatgacggtggccgccatgggcgtgccgcccctcccgctgttcatcttcagcctcaaggacaccctgaagcggcgctcctggcccctgaacgagggggtcatggccgtgggcctcgtgagcatcctggcctccagcctgctccgcaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcggatcaaggacgacgagacggagaacatcctcaccgtgctgctgaagaccgccctcctgatcgtgtccggcatcttcccgtacagcatccccgccaccctgctcgtctggcacacgtggcagaagcagacccagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacacgatgtggcacgtgacccgcggcgcggtcctcacctacaacgggaagcggctggagcccaactgggcctccgtgaagaaggacctgatcagctacggcgggggctggcgcctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgggagggcaaggtggtcgggctgtacggcaacggggtggtgaccaagaacggcgggtacgtctccggcatcgcccagaccaacgccgagccggacggccccacccccgagctggaggaggagatgttcaagaagcgcaacctcacgatcatggacctgcaccccgggagcggcaagacccggaagtacctgccggccatcgtgcgcgaggcgatcaagcggcgcctccggaccctgatcctggcccccacccgcgtggtcgccgccgagatggaggaggccctcaaggggctgcccatccggtaccagacgaccgcgaccaagtccgagcacaccggccgcgagatcgtggacctgatgtgccacgccacgttcaccatgcggctcctgagccccgtgcgcgtcccgaactacaacctgatcatcatggacgaggcccacttcaccgaccccgcctccatcgccgcgcgggggtacatcagcacccgcgtgggcatgggcgaggccgccgccatcttcatgacggcgacgccgcccgggaccgccgacgccttcccgcagtccaacgcccccatccaggacgaggagcgggacatccccgagcgcagctggaactccggcaacgagtggatcaccgacttcgccgggaagacggtgtggttcgtccccagcatcaaggcgggcaacgacatcgccaactgcctccgcaagaacgggaagaaggtgatccagctgtcccggaagaccttcgacaccgagtaccagaagaccaagctgaacgactgggacttcgtggtcacgaccgacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccggacctactccgacccgctggccctcaaggagttcaaggacttcgccgcgggccgcaagagcatcgccctggacctggtgaccgagatcgggcgcgtcccctcccacctcgcccaccggacccgcaacgccctggacaacctggtgatgctccacacgagcgagcacggcgggaaggcctaccggcacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccacgaagcgggacctgggcatgtccaaggagccgggggtggtcagccccacctcctacctggacgtggacctccaccccgccagcgcctggaccctgtacgccgtggcgaccacggtcatcacccccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgggaggcccagaagcgcacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgacgctggccaccggccccatcaccaccctctgggagggctcccccgggaagttctggaacacgaccatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggagttcgacctctacaagaagtccggcatcacggaggtggaccggaccgaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccgcacgatccgggtgctgaagatggtggagccgtggctcaagaacaaccagttctgcatcaaggtcctgaacccctacatgcccaccgtgatcgagcacctggagcgcctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcacgatgacccaccggcgcccgaccatcgagaaggacgtcgacctcggcgcgggcacccggcacgtgaacgccgagcccgagacgcccaacatggacgtgatcggggagcgcatcaagcggatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgcgtgttcaaggagaaggtggacacccggaccccgcgcagcatgcccggcacccggcgcgtcatgggcatcacggccgagtggctctggcggaccctggggcgcaacaagaagccccggctgtgcacccgcgaggagttcaccaagaaggtgcggacgaacgccgccatgggcgcggtgttcaccgaggagaaccagtgggactccgccaaggccgccgtcgaggacgaggacttctggaagctcgtggaccgcgagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccggcacggtgatggacatcatcagccggaaggaccagcgcggctccggccaggtgggcacctacgggctgaacaccttcaccaacatggaggcccagctcatccggcagatggagggcgagggggtcctgagcaaggccgacctggagaacccccacctcccggagaagaagatcacgcagtggctggagaccaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccggcgcgacctccgcctggcgtccaacgccatctgcagcgccgtgcccgtccactgggtgccgacctcccggacgacctggagcatccacgcccaccaccagtggatgaccaccgaggacatgctgacggtgtggaaccgcgtctggatcgaggacaacccctggatggaggacaagacccccgtgaccacctgggagaacgtgccctacctcgggaagcgggaggaccagtggtgcggcagcctgatcgggctgacgtcccgcgccacctgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10135 - RNA, 9873 nt, synthetic construct
  misc_feature 1..9873: note = derived and/or modified CDS sequence (opt1) from DENV-3__EU529702__SS-prME
  source 1..9873: mol_type = other RNA
accagcctctgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacgtgggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaaggtgcccttcagcaccgaggacgggcagggcaaggcgcacaacggccgcctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgtgatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggcgaagatcgtcaccgccgagacccagaacagctccttcatcatcgacggccccaacacgcccgagtgccccagcgcctcccgggcctggaacgtgtgggaggtggaggactacgggttcggcgtcttcagcaccaacatctggctcaagctgcgcgaggtgtacacccagctgtgcgaccaccggctcatgagcgcggccgtgaaggacgagcgcgccgtccacgccgacatgggctactggatcgagtcccagaagaacgggagctggaagctggagaaggcctccctgatcgaggtgaagacctgcacctggcccaagtcccacacgctctggtccaacggcgtgctggagagcgacatgatcatccccaagtccctggcggggcccatcagccagcacaactaccggccgggctaccacacccagaccgccgggccctggcacctcggcaagctggagctggacttcaactactgcgagggcaccacggtcgtgatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccgggaaggtggacaacttcaccatgggcgccctgtgcctcgccatcctgttcgaggaggtcatgcgggggaagttcggcaagaagcacatgatcgcgggggtgttcttcacgttcgtgctgctcctgagcggccagatcacctggcgcgacatggcccacaccctgatcatgatcggctccaacgccagcgaccggatggggatgggcgtcacctacctcgccctgatcgccacgttcaagatccagcccttcctggcgctcgggttcttcctgcgcaagctgaccagccgggagaacctcctgctgggcgtgggcctcgccatggccaccaccctgcagctgcccgaggacatcgagcagatggccaacgggatcgcgctcggcctgatggccctgaagctcatcacgcagttcgagacctaccagctgtggaccgccctgatctccctgacctgcagcaacacgatcttcaccctgaccgtcgcctggcgcaccgccacgctgatcctcgcgggggtgtccctgctgccggtgtgccagagctccagcatgcggaagaccgactggctccccatgaccgtcgccgccatgggcgtgccgcccctcccgctgttcatcttctccctcaaggacaccctgaagcgccgcagctggcccctgaacgagggggtgatggccgtcggcctcgtgtccatcctggccagctccctgctccggaacgacgtgcccatggcgggccccctggtcgccgggggcctgctcatcgcctgctacgtgatcacggggaccagcgccgacctgaccgtggagaaggccgcggacgtcacctgggaggaggaggccgagcagacgggcgtgtcccacaacctgatgatcaccgtggacgacgacgggaccatgcgcatcaaggacgacgagaccgagaacatcctcaccgtcctgctgaagacggccctcctgatcgtgagcggcatcttcccgtactccatccccgccaccctgctcgtgtggcacacctggcagaagcagacccagcggagcggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgcggtgctcacgtacaacgggaagcgcctggagcccaactgggccagcgtcaagaaggacctgatctcctacggcgggggctggcggctcagcgcccagtggcagaagggggaggaggtccaggtgatcgccgtcgagcccggcaagaaccccaagaacttccagaccatgcccggcaccttccagaccacgaccggggagatcggcgcgatcgccctggacttcaagcccgggaccagcggctcccccatcatcaaccgcgagggcaaggtggtggggctgtacggcaacggggtcgtgaccaagaacggcgggtacgtgagcggcatcgcccagacgaacgccgagccggacggccccacccccgagctggaggaggagatgttcaagaagcggaacctcaccatcatggacctgcaccccgggtccggcaagacccgcaagtacctgccggccatcgtccgggaggcgatcaagcgccggctccgcacgctgatcctggcccccacccgggtggtggccgccgagatggaggaggccctcaaggggctgcccatccgctaccagaccaccgcgaccaagagcgagcacaccggccgggagatcgtcgacctgatgtgccacgccaccttcaccatgcgcctcctgtcccccgtgcgggtgccgaactacaacctgatcatcatggacgaggcccacttcacggaccccgccagcatcgccgcgcgcgggtacatctccacccgggtcggcatgggcgaggccgccgccatcttcatgaccgcgacgccgcccgggacggccgacgccttcccgcagagcaacgcccccatccaggacgaggagcgcgacatccccgagcgctcctggaacagcggcaacgagtggatcaccgacttcgccgggaagaccgtgtggttcgtgccctccatcaaggcgggcaacgacatcgccaactgcctccggaagaacgggaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacggccccgagcgcgtgatcctggccgggcccatgccggtcaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagacgttcgtcgagctgatgcgccgcggggacctccccgtgtggctggcgcacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctacagcgacccgctggccctcaaggagttcaaggacttcgccgcgggccgcaagtccatcgccctggacctggtgacggagatcgggcgggtgcccagccacctcgcccaccgcacccggaacgccctggacaacctggtcatgctccacaccagcgagcacggcgggaaggcctaccgccacgcggtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcggacgccccaggacaaccagctggcctacgtggtcatcgggatcctcacgctggccgccatcatcgccgcgaacgagatgggcctgctcgagaccaccaagcgcgacctgggcatgagcaaggagccgggggtggtgtcccccaccagctacctggacgtcgacctccaccccgcctccgcctggacgctgtacgccgtggcgaccaccgtgatcacccccatgctgcggcacacgatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgaccctgaccgccgccgtgctcctgctgatcacgcactacgccatcatcggccccggcctccaggcgaaggccacccgcgaggcccagaagcggaccgccgccgggatcatgaagaacccgaccgtcgacggcatcatgacgatcgacctggaccccgtgatctacgacagcaagttcgagaagcagctgggccaggtgatgctcctggtcctgtgcgcggtgcagctcctgctgatgcgcacctcctgggccctctgcgaggccctgaccctggccaccggccccatcacgaccctctgggagggcagccccgggaagttctggaacaccaccatcgcggtgtccatggccaacatcttccggggcagctacctggccggggccggcctggccttctccatcatgaagtccgtcgggacgggcaagcgcggcaccgggagccagggcgagaccctcggggagaagtggaagaagaagctgaaccagctgtcccggaaggagttcgacctctacaagaagtccggcatcaccgaggtggaccgcaccgaggcgaaggaggggctgaagcggggcgagatcacgcaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcaccgaggtgcgcggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacgcacgagatgtactggatcagcaacggcaccgggaacatcgtggcctccgtcaacatggtgagccgcctcctgctgaaccggttcaccatgacccaccgccggccgacgatcgagaaggacgtggacctcggcgcgggcacccgccacgtcaacgccgagcccgagacccccaacatggacgtgatcggggagcggatcaagcgcatcaaggaggagcacaactccacctggcactacgacgacgagaacccgtacaagacgtgggcctaccacggcagctacgaggtcaaggccaccgggtccgccagcagcatgatcaacggcgtggtgaagctgctgaccaagccctgggacgtcgtgcccatggtgacccagatggcgatgacggacaccacccccttcgggcagcagcgggtcttcaaggagaaggtggacacccgcacgccgcggtccatgcccggcacccgccgggtgatgggcatcaccgccgagtggctctggcgcaccctggggcggaacaagaagccccgcctgtgcacgcgggaggagttcaccaagaaggtccgcaccaacgccgccatgggcgcggtgttcaccgaggagaaccagtgggacagcgccaaggccgccgtggaggacgaggacttctggacgctcgtcgaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatctcccgcaaggaccagcggggcagcggccaggtgggcacgtacgggctgaacaccttcaccaacatggaggcccagctcatccgccagatggagggcgagggggtgctgtccaaggccgacctggagaacccccacctcccggagaagaagatcacccagtggctggagacgaagggcgtcgagcggctgaagcgcatggcgatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtgcactgggtcccgaccagccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggctccctgatcgggctgaccagccgggccacgtgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10136 - RNA, 9873 nt, synthetic construct
  misc_feature 1..9873: note = derived and/or modified CDS sequence (opt1) from DENV-3__EU529703__SS-prME
  source 1..9873: mol_type = other RNA
accagcctgtgcctcatgatgatcctgcccgcggccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgccccgtgcaagatccccttcagcaccgaggacgggcagggcaaggcccacaacggccgcctgatcacggccaaccccgtggtcaccaagaaggaggagcccgtgaacatcgaggcggagccgcccttcggggagagcaacatcgtgatcggcatcggggacaacgccctgaagatcaactggtacaagaagggctccagcatcgggaagatgttcgaggccaccgcccggggcgcccgccggatggcgatcctgggcgacaccgcctgggacttcgggtccgtcggcggggtgctcaacagcctgggcaagatggtgcaccagatcttcgggtccgcctacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgcggtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgcgggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgcggtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgcgggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgcgctgatcgccaccttcaagatccagcccttcctggccctcgggttcttcctgcgcaagctgaccagccgggagaacctcctgctgggcgtcggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtggcgtggcgcacggccaccctgatcctcgccggggtgagcctgctgccggtctgccagtccagctccatgcggaagaccgactggctccccatggccgtggccgcgatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggccggccccctggtggccgggggcctgctcatcgcgtgctacgtcatcacggggacctccgccgacctgaccgtggagaaggccgccgacatcacctgggaggaggaggccgagcagacgggcgtgagccacaacctgatgatcaccgtcgacgacgacgggaccatgcgcatcaaggacgacgagaccgagaacatcctcaccgtgctgctgaagacggcgctcctgatcgtgtccggcatcttcccgtacagcatccccgccaccctgctcgtctggcacacctggcagaagcagacccagcggtccggcgtgctgtgggacgtgcccagcccgcccgagacgcagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcgcagacgaacgccgagccggacggccccacccccgagctggaggaggagatgttcaagaagcggaacctcaccatcatggacctgcaccccgggagcggcaagacccgcaagtacctgccggccatcgtgcgggaggccatcaagcgccggctccgcacgctgatcctggcccccacccgggtggtcgcggccgagatggaggaggccctcaaggggctgcccatccgctaccagaccaccgccacgaagtccgagcacaccggccgggagatcgtggacctgatgtgccacgccaccttcaccatgcgcctcctgagccccgtgcgggtcccgaactacaacctgatcatcatggacgaggcgcacttcacggaccccgcctccatcgccgcccgcgggtacatcagcacccgggtgggcatgggcgaggcggccgccatcttcatgaccgccacgccgcccgggacggccgacgcgttcccgcagtccaacgcccccatccaggacgaggagcgcgacatccccgagcgcagctggaactccggcaacgagtggatcaccgacttcgccgggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgcgaacttcaaggccgaccgggtgatcgacccgcgccggtgcctcaagcccgtgatcctgacggacggccccgagcgcgtcatcctggccgggcccatgccggtgaccgccgcctccgcggcccagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgaagggcgagtcccggaagacgttcgtcgagctgatgcgccgcggggacctccccgtgtggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcgcgcacctactccgacccgctggccctcaaggagttcaaggacttcgccgccggccgcaagagcatcgccctggacctggtgacggagatcgggcgggtcccctcccacctcgcgcaccgcacccggaacgccctggacaacctggtgatgctccacaccagcgagcacggcgggcgcgcctaccggcacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgcgagctccggcatgctctggatggccgagatcccgctgcagtggatcgccagcgccatcgtgctggagttcttcatgatggtgctcctgatccccgagcccgagaagcagcgcacgccccaggacaaccagctggcctacgtcgtgatcgggatcctcacgctggcggccatcatcgccgccaacgagatgggcctgctcgagaccaccaagcgggacctgggcatgtccaaggagccgggggtggtcagccccacctcctacctggacgtggacctccaccccgcgagcgcctggacgctgtacgccgtggccaccaccgtcatcacccccatgctgcgccacacgatcgagaactccaccgccaacgtgagcctcgcggccatcgccaaccaggccgtggtcctgatgggcctggacaaggggtggccgatctccaagatggacctcggcgtgcccctgctggccctcgggtgctacagccaggtgaaccccctgaccctgaccgcggccgtcctcctgctgatcacgcactacgccatcatcggccccggcctccaggccaaggccacccgggaggcgcagaagcgcaccgccgccgggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcggaccagctgggcgctctgcgaggccctgaccctggccaccggccccatcacgaccctctgggagggctcccccgggaagttctggaacaccaccatcgccgtcagcatggccaacatcttccgcggctcctacctggcgggggccggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtcagccggggctccgcgaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgtcccgcaacagcacgcacgagatgtactggatctccaacggcaccgggaacatcgtcgccagcgtgaacatggtgtcccggctcctgctgaaccgcttcaccatgacccaccggcgcccgacgatcgagaaggacgtcgacctcggcgccggcacccggcacgtgaacgccgagcccgagacccccaacatggacgtgatcggggagcgcatcaagcggatcaaggaggagcacaacagcacctggcactacgacgacgagaacccgtacaagacgtgggcgtaccacggctcctacgaggtcaaggccaccgggagcgcctccagcatgatcaacggcgtggtgaagctgctgaccaagccctgggacgtcgtgcccatggtcacccagatggccatgacggacaccacccccttcgggcagcagcgcgtgttcaaggagaaggtggacacccggacgccgcgcagcatgcccggcacccggcgcgtcatgggcatcaccgcggagtggctctggcggaccctggggcgcaacaagaagccccggctgtgcacgcgcgaggagttcaccaagaaggtgcgcaccaacgccgccatgggcgccgtgttcaccgaggagaaccagtgggactccgccaaggcggccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcccggtacctggagttcgaggcgctcgggttcctgaacgaggaccactggttcagccgcgagaactcctacagcggcgtcgagggggagggcctgcacaagctcggctacatcctgcgggacatctccaagatccccgggggcgccatgtacgccgacgacacggccgggtgggacacccgcatcaccgaggacgacctgcacaacgaggagaagatcacccagcagatggacccggagcaccggcagctcgccaacgcgatcttcaagctgacgtaccagaacaaggtggtgaaggtccagcgccccacccccaccggcaccgtgatggacatcatcagccggaaggaccagcgcggctccggccaggtgggcacctacgggctgaacacgttcaccaacatggaggcccagctcatccggcagatggagggcgagggggtcctgagcaaggccgacctggagtcccaccacctccccgagaagaagatcacccagtggctggagaccaagggcgtggagcgcctgaagcggatggccatcagcggcgacgactgcgtggtcaagccgatcgacgaccgcttcgccaacgcgctcctggccctgaacgacatggggaaggtgcggaaggacatcccccagtggcagccctccaagggctggcacgactggcagcaggtccccttctgcagccaccacttccacgagctcatcatgaaggacgggcgcaagctggtcgtgccgtgccggccccaggacgagctgatcggccgcgcccggatctcccagggggccggctggagcctccgcgagacggcgtgcctgggcaaggcctacgcccagatgtggtccctgatgtacttccaccgccgggacctccgcctggccagcaacgccatctgctccgcggtgcccgtccactgggtgcccaccagccggaccacctggagcatccacgcccaccaccagtggatgacgaccgaggacatgctgaccgtgtggaaccgcgtctggatcgaggacaacccgtggatggaggacaagacccccgtgacgacctgggagaacgtgccctacctcgggaagcgggaggaccagtggtgcggctccctgatcgggctgaccagccgcgccacctgggcccagaacatccccacggccatccagcaggtccggtccctcatcggcaacgaggagttcctggactacatgccgagcatgaagcgcttccggaaggaggaggagtccgagggggcgatctggtga

SEQ ID NO: 10137 - RNA, 9873 nt, synthetic construct
  misc_feature 1..9873: note = derived and/or modified CDS sequence (opt1) from DENV-3__EU529705__SS-prME
  source 1..9873: mol_type = other RNA
accagcctctgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtggggatcggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcggcctgaaggggatgagctacgccatgtgcaccaacacgttcgtgctgaagaaggaggtctccgagacccagcacggcaccatcctcatcaaggtggagtacaagggggaggacgtgccgtgcaaggtccccttcagcaccgaggacggccagggcaaggcgcacagcgggcgcctgatcacggccaaccccgtggtgaccaagaaggaggagcccgtcaacatcgaggccgagccgcccttcggcgagtccaacatcgtgatcgggatcggcgacaacgccctgaagatcaactggtacaagaaggggagctccatcggcaagatgttcgaggcgaccgcccggggcgcccgccggatggccatcctgggggacaccgcctgggacttcggcagcgtcgggggcgtcctcaactccctggggaagatggtgcaccagatcttcggcagcgcgtacacggccctgttctccggcgtgagctgggtcatgaagatcgggatcggcatcctcctgacctggatcgggctgaactccaagaacaccagcatgtccttcagctgcatcgtgatcggcatcatcaccctctacctgggggccgtggtccaggccgacatgggctgcgtgatcaactggaagggcaaggagctgaagtgcgggtccggcatcttcgtgacgaacgaggtccacacctggaccgagcagtacaagttccaggccgacagccccaagcgcctcgcgaccgccatcgccggggcctgggagaacggcgtgtgcgggatccgctccacgacccggatggagaacctgctgtggaagcagatcgccaacgagctcaactacatcctgtgggagaacaacatcaagctgaccgtggtcgtgggcgacatcatcggcgtgctcgagcaggggaagcgcaccctgacgccccagccgatggagctgaagtacagctggaaggcgtggggcaaggccaagatcgtcaccgccgagacccagaactccagcttcatcatcgacgggcccaacacccccgagtgcccctccgccagccgggcgtggaacgtgtgggaggtggaggactacggcttcggcgtcttcacgaccaacatctggctcaagctgcgcgaggtgtacacccagctgtgcgaccaccggctcatgagcgccgccgtgaaggacgagcgcgccgtccacgccgacatggggtactggatcgagtcccagaagaacggcagctggaagctggagaaggcgtccctgatcgaggtgaagacctgcacctggcccaagtcccacacgctctggtccaacggggtgctggagagcgacatgatcatccccaagtccctggccggccccatcagccagcacaactaccggccggggtaccacacccagaccgccggcccctggcacctcggcaagctggagctggacttcaactactgcgaggggaccacggtcgtgatcaccgagaactgcggcacccgcgggccctccctccggaccacgaccgtgagcggcaagctgatccacgagtggtgctgccgctcctgcaccctgcccccgctccggtacatgggggaggacggctgctggtacggcatggagatccgccccatcagcgagaaggaggagaacatggtcaagtccctggtgagcgccgggtccggcaaggtggacaacttcaccatgggggtcctgtgcctcgccatcctgttcgaggaggtgatgcggggcaagttcgggaagaagcacatgatcgcgggcgtgttcttcacgttcgtcctgctcctgagcggccagatcacctggcgcgacatggcccacaccctgatcatgatcgggtccaacgccagcgaccggatgggcatgggggtgacctacctcgccctgatcgccacgttcaagatccagcccttcctggcgctcggcttcttcctgcgcaagctgaccagccgggagaacctcctgctgggcgtggggctcgccatggccaccaccctgcagctgcccgaggacatcgagcagatggccaacggcatcgcgctcgggctgatggccctgaagctcatcacgcagttcgagacctaccagctgtggaccgccctgatctccctgacctgcagcaacacgatcttcaccctgaccgtcgcctggcgcaccgccacgctgatcctcgcgggcgtgtccctgctgccggtctgccagagctccagcatgcggaagaccgactggctccccatgaccgtggccgccatgggggtgccgcccctcccgctgttcatcttctccctcaaggacaccctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcacgggcaccagcgccgacctgaccgtcgagaaggccgcggacgtgacctgggaggaggaggccgagcagacgggggtgtcccacaacctgatgatcaccgtcgacgacgacggcaccatgcgcatcaaggacgacgagaccgagaacatcctcaccgtgctgctgaagacggccctcctgatcgtgagcggcatcttcccgtactccatccccgccaccctgctcgtctggcacacctggcagaagcagacccagcggagcggggtgctgtgggacgtgcccagcccgcccgagacgcagaaggccgagctggaggagggcgtctaccgcatcaagcagcaggggatcttcggcaagacccaggtgggggtgggcgtccagaaggagggcgtgttccacaccatgtggcacgtgacccgcggggcggtcctcacgtacaacggcaagcgcctggagcccaactgggccagcgtgaagaaggacctgatctcctacgggggcgggtggcggctcagcgcccagtggcagaagggcgaggaggtgcaggtcatcgccgtggagcccggcaagaaccccaagaacttccagaccatgcccgggaccttccagaccacgaccggcgagatcggggcgatcgccctggacttcaagcccggcaccagcggctcccccatcatcaaccgcgaggggaaggtggtcggcctgtacgggaacggcgtggtgaccaagaacgggggctacgtcagcggcatcgcccagacgaacgccgagccggacgggcccacccccgagctggaggaggagatgttcaagaagcggaacctcaccatcatggacctgcaccccggctccgggaagacccgcaagtacctgccggccatcgtgcgggaggcgatcaagcgccggctccgcacgctgatcctggcccccacccgggtggtcgccgccgagatggaggaggccctcaagggcctgcccatccgctaccagaccaccgcgaccaagagcgagcacaccgggcgggagatcgtggacctgatgtgccacgccaccttcaccatgcgcctcctgtcccccgtgcgggtcccgaactacaacctgatcatcatggacgaggcccacttcacggaccccgccagcatcgccgcgcgcggctacatctccacccgggtgggcatgggggaggccgccgccatcttcatgaccgcgacgccgcccggcacggccgacgccttcccgcagagcaacgcccccatccaggacgaggagcgcgacatccccgagcgctcctggaacagcgggaacgagtggatcaccgacttcgccggcaagaccgtgtggttcgtcccctccatcaaggcggggaacgacatcgccaactgcctccggaagaacggcaagaaggtgatccagctgagccgcaagaccttcgacacggagtaccagaagaccaagctgaacgactgggacttcgtggtcaccaccgacatctccgagatgggcgccaacttcaaggccgaccgggtgatcgacccgcgccggtgcctcaagcccgtgatcctgacggacgggcccgagcgcgtcatcctggccggccccatgccggtgaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacccccgagggcatcatcccggccctcttcgagcccgagcgggagaagtccgccgccatcgacggcgagtaccgcctgaagggggagagccggaagacgttcgtcgagctgatgcgccggggcgacctccccgtgtggctggcgcacaaggtcgcctccgaggggatcaagtacaccgaccgcaagtggtgcttcgacggccagcggaacaaccagatcctggaggagaacatggacgtggagatctggaccaaggagggcgagaagaagaagctccgcccccggtggctggacgcccgcacctacagcgacccgctggccctcaaggagttcaaggacttcgccgcggggcgcaagtccatcgccctggacctggtgacggagatcggccgggtccccagccacctcgcccaccgcacccggaacgccctggacaacctggtgatgctccacaccagcgagcacgggggccgcgcctaccggcacgcggtggaggagctgcccgagaccatggagacgctgctcctgctggggctcatgatcctgctgaccggcggcgccatgctgttcctgatctccgggaagggcatcgggaagaccagcatcggcctgatctgcgtcatcgcctccagcgggatgctctggatggccgagatcccgctgcagtggatcgcctccgcgatcgtgctggagttcttcatgatggtgctcctgatccccgagcccgagaagcagcgcacgccccaggacaaccagctggcctacgtcgtgatcggcatcctcacgctggccgccatcatcgccgcgaacgagatgggcctgctcgagaccaccaagcgggacctggggatgagcaaggagccgggcgtggtctcccccaccagctacctggacgtggacctccaccccgcctccgcctggacgctgtacgccgtggcgaccaccgtcatcacccccatgctgcgccacacgatcgagaacagcaccgccaacgtgtccctcgccgccatcgccaaccaggcggtggtcctgatggggctggacaagggctggccgatcagcaagatggacctcggggtgcccctgctggccctcggctgctactcccaggtgaaccccctgaccctgaccgccgccgtcctcctgctgatcacgcactacgccatcatcggccccgggctccaggcgaaggccacccgggaggcccagaagcgcaccgccgccggcatcatgaagaacccgaccgtggacgggatcatgacgatcgacctggaccccgtgatctacgacagcaagttcgagaagcagctgggccaggtcatgctcctggtgctgtgcgcggtgcagctcctgctgatgcggacctcctgggccctctgcgaggccctgaccctggccaccggccccatcacgaccctctgggaggggagccccggcaagttctggaacaccaccatcgcggtctccatggccaacatcttccgcgggagctacctggccggcgccgggctggccttctccatcatgaagtccgtgggcacgggcaagcgggggaccggcagccagggggagaccctcggcgagaagtggaagaagaagctgaaccagctgtcccgcaaggagttcgacctctacaagaagtccgggatcaccgaggtggaccggaccgaggcgaaggagggcctgaagcgcggcgagatcacgcaccacgccgtctcccgggggagcgccaagctgcagtggttcgtggagcgcaacatggtgatcccggagggccgggtcatcgacctcgggtgcggccgcgggggctggtcctactactgcgccggcctgaagaaggtgaccgaggtgcgggggtacaccaagggcgggcccggccacgaggagcccgtccccatgagcacctacgggtggaacatcgtgaagctgatgtccggcaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacgggggcatgctggtgcggaaccccctgagccgcaactccacgcacgagatgtactggatcagcaacgggaccggcaacatcgtcgcctccgtgaacatggtgagccggctcctgctgaaccgcttcaccatgacccaccggcgcccgacgatcgagaaggacgtcgacctcggcgcggggacccggcacgtgaacgccgagcccgagacccccaacatggacgtgatcggcgagcgcatcaagcggatcaaggaggagcacaactccacctggcactacgacgacgagaacccgtacaagacgtgggcctaccacgggagctacgaggtcaaggccaccggctccgccagcagcatgatcaacggggtggtcaagctgctgaccaagccctgggacgtggtgcccatggtcacccagatggcgatgacggacaccacccccttcggccagcagcgcgtgttcaaggagaaggtggacacccggacgccgcgctccatgcccggcacccggcgcgtcatggggatcaccgccgagtggctctggcggaccctgggccgcaacaagaagccccggctgtgcacgcgcgaggagttcaccaagaaggtgcgcaccaacgccgccatgggggcggtgttcaccgaggagaaccagtgggacagcgccaaggccgccgtcgaggacgaggacttctggatcctcgtggaccgggagcgcgagctgcacaagctgggcaagtgcgggtcctgcgtgtacaacatgatgggcaagcgggagaagaagctcggcgagttcgggaaggccaagggcagccgcgcgatctggtacatgtggctgggggcccggtacctggagttcgaggccctcggcttcctgaacgaggaccactggttctcccgcgagaacagctactccggggtcgagggcgagggcctgcacaagctcgggtacatcctgcgggacatcagcaagatccccggcggggccatgtacgccgacgacacggcgggctgggacacccgcatcaccgaggacgacctgcacaacgaggagaagatcacccagcagatggacccggagcaccggcagctcgcctccgccatcttcaagctgacgtaccagaacaaggtggtgaaggtccagcgccccacccccaccggcaccgtgatggacatcatcagccggaaggaccagcgcgggtccggccaggtggggacctacggcctgaacacgttcaccaacatggaggcccagctcatccggcagatggagggggagggcgtcctgagcaaggccgacctggagaacccccacctcccggagaagaagatcacccagtggctggagaccaagggcgtggagcgcctgaagcggatggcgatctccggggacgactgcgtggtcaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccggatcagccagggcgcgggctggtccctccgcgagacggcctgcctggggaaggcctacgcccagatgtggagcctgatgtacttccaccgccgggacctccgcctggcgtccaacgccatctgcagcgccgtgcccgtccactgggtgccgaccagccggaccacctggtccatccacgcccaccaccagtggatgacgaccgaggacatgctgaccgtgtggaaccgcgtctggatcgaggacaacccctggatggaggacaagacccccgtgacgacctgggagaacgtgccctacctcggcaagcgggaggaccagtggtgcgggagcctgatcggcctgacctcccgcgccacctgggcgcagaacatcccgacggccatccagcaggtccggagcctcatcgggaacgaggagttcctggactacatgccctccatgaagcgcttccggaaggaggaggagagcgagggcgccatctggtga

SEQ ID NO: 10138 - RNA, 9873 nt, synthetic construct
  misc_feature 1..9873: note = derived and/or modified CDS sequence (opt1) from DENV-3__EU596492__SS-prME
  source 1..9873: mol_type = other RNA
accagcctgtgcctcatgatgatcctgcccgccgccctggcgttccacctcaccagccgcgacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcggcaggtcgagaaggtggagacctgggcgctgcgccacccggggttcacgatcctcgccctgttcctggcccactacatcggcacctccctcacccagaaggtggtgatcttcgtcctgctgatgctcgtgacccccagcatgacgatgcggtgcgtgggggtcggcaaccgcgacttcgtggagggcctgtccggggccacctgggtggacgtcgtgctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgccctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgcggagatcacgccccaggccagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcgcacgccaagaagcaggaggtcgtggtgctggggtcccaggagggcgccatgcacaccgccctcaccggggccacggagatccagaacagcggcgggacctccatcttcgcgggccacctgaagtgccggctgaagatggacaagctcgagctgaagggcatgagctacgccatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgcgaaccccgtcgtgacgaagaaggaggagcccgtgaacatcgaggccgagccgcccttcggggagagcaacatcgtcatcggcatcggggacaacgccctgaagatcaactggtacaagaagggctccagcatcgggaagatgttcgaggccaccgcccggggcgcgcgccggatggccatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgcgatcgggatcatcaccctctacctgggcgccgtggtgcaggccgacaccgggtgcgtcgtgaactggaagggcaaggagctgaagtgcggcagcgggatcttcgtgacgaacgaggtccacacctggaccgagcagtacaagttccaggccgactcccccaagcgcctcgccaccgcgatcgccggcgcctgggagaacggggtgtgcggcatccgcagcacgacccggatggagaacctgctgtggaagcaggtcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgccgcggtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgcggggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcgtccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggccctgaagctcatcacccagttcgagacctaccagctgtggaccgcgctgatcagcctcacgtgctccaacaccatcttcaccctgaccgtggcctggcgcacggccaccctgatcctcgccggggtcagcctgctgccggtgtgccagtccagctccatgcggaagtccgactggctccccatgaccgtggccgcgatgggcgtgccgcccctcccgctgttcatcttctccctcaaggacaccctgaagcgccgcagctggcccctgaacgagggggtgatggccgtgggcctcgtctccatcctggccagctccctgctccggaacgacgtgcccatggccggccccctggtggccgggggcctgctcatcgcgtgctacgtcatcacggggaccagcgccgacctgaccgtggagaaggccgccgacgtgacctgggaggaggaggccgagcagacgggcgtctcccacaacctgatgatcaccgtggacgacgacgggaccatgcgcatcaaggacgacgagaccgagaacatcctcaccgtgctgctgaagacggcgctcctgatcgtcagcggcatcttcccgtactccatccccgccaccctgctcgtgtggcacacctggcagaagcagacccggcgcagcggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggcgagcgtgaagaaggacctgatctcctacggcgggggctggcgcctcagcgcccagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggctcccccatcatcaaccgggagggcaaggtcgtggggctgtacggcaacggggtggtcaccaagaacggcgggtacgtgagcggcatcgcgcagacgaacgccgagccggacggccccacccccgagctggaggaggagatgttcaagaagcgcaacctcaccatcatggacctgcaccccgggtccggcaagacccggaagtacctgccggccatcgtgcgcgaggccatcaagcggcgcctccggacgctgatcctggcccccacccgcgtcgtggcggccgagatggaggaggccctcaaggggctgcccatccggtaccagaccaccgccaccaagagcgagcacaccggccgcgagatcgtggacctgatgtgccacgccaccttcaccatgcggctcctgtcccccgtccgcgtgccgaactacaacctgatcatcatggacgaggcgcacttcacggaccccgccagcatcgccgcccgggggtacatctccacccgcgtgggcatgggcgaggcggccgccatcttcatgaccgccacgccgcccgggacggccgacgcgttcccgcagagcaacgcccccatccaggacgaggagcgcgacatccccgagcggtcctggaacagcggcaacgagtggatcaccgacttcgccgggaagaccgtctggttcgtgccctccatcaaggccggcaacgacatcgccaactgcctccgcaagaacgggaagaaggtgatccagctgagccggaagaccttcgacacggagtaccagaagaccaagctgaacgactgggacttcgtcgtgaccaccgacatctccgagatgggcgcgaacttcaaggccgaccgcgtgatcgacccgcggcgctgcctcaagcccgtcatcctgacggacggccccgagcgggtgatcctggccgggcccatgccggtgaccgccgccagcgcggcccagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcgcgcacctacagcgacccgctggccctcaaggagttcaaggacttcgccgccggccggaagtccatcgccctggacctggtcacggagatcgggcgcgtgcccagccacctcgcgcaccggacccgcaacgccctggacaacctggtgatgctccacaccagcgagcacggcgggaaggcctaccggcacgccgtcgaggagctgcccgagaccatggagacgctgctcctgctgggcctcatgatcctgctgaccgggggcgccatgctgttcctgatctccggcaaggggatcggcaagaccagcatcgggctgatctgcgtgatcgcgtccagcggcatgctctggatggccgagatcccgctgcagtggatcgcctccgccatcgtgctggagttcttcatgatggtcctcctgatccccgagcccgagaagcagcgcacgccccaggacaaccagctggcctacgtggtgatcgggatcctcacgctggcggccatcatcgccgccaacgagatgggcctgctcgagaccaccaagcgggacctgggcatgagcaaggagccgggggtcgtgtcccccaccagctacctggacgtggacctccaccccgcgtccgcctggacgctgtacgccgtcgccaccaccgtgatcacccccatgctgcgccacacgatcgagaacagcaccgccaacgtgtccctcgcggccatcgccaaccaggccgtcgtgctgatgggcctgaacaaggggtggccgatcagcaagatggacctcggcgtgcccctgctggccctcgggtgctactcccaggtcaaccccctgaccctgaccgcggccgtgctcctgctgatcacgcactacgccatcatcggccccggcctccaggccaaggccacccgggaggcgcagaagcgcaccgccgccgggatcatgaagaacccgaccgtggacggcatcatgacgatcgacctggaccccgtcatctacgacagcaagttcgagaagcagctgggccaggtgatgctcctggtgctgtgcgccgtccagctcctgctgatgcggacctcctgggcgctctgcgaggccctgaccctggccaccggccccatcacgaccctctgggagggcagccccgggaagttctggaacaccaccatcgccgtgtccatggccaacatcttccgcggcagctacctggcgggggccggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtcgaccggaccgaggccaaggaggggctgaagcgcggcgagatcacgcaccacgccgtgtcccggggcagcgcgaagctgcagtggttcgtggagcgcaacatggtcatcccggaggggcgggtgatcgacctcggctgcgggcgcggcgggtggtcctactactgcgccggcctgaagaaggtgaccgaggtccggggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacgcacgagatgtactggatcagcaacggcaccgggaacatcgtggcctccgtgaacatggtcagccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaactccacctggcactacgacgacgagaacccgtacaagacgtgggcgtaccacggcagctacgaggtgaaggccaccgggtccgccagcagcatgatcaacggcgtcgtgaagctgctgaccaagccctgggacgtggtccccatggtgacccagatggccatgacggacaccacccccttcgggcagcagcgcgtgttcaaggagaaggtcgacacccggacgccgcgctccatgcccggcacccggcgcgtgatgggcatcaccgcggagtggctctggcggaccctggggcgcaacaagaagccccggctgtgcacgcgcgaggagttcaccaagaaggtgcgcaccaacgccgccatgggcgccgtcttcaccgaggagaaccagtgggacagcgccaaggcggccgtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgccatctggtacatgtggctgggcgcccggtacctggagttcgaggcgctcgggttcctgaacgaggaccactggttctcccgcgagaacagctactccggcgtggagggggagggcctgcacaagctcggctacatcctgcgggacatcagcaagatccccgggggcgccatgtacgccgacgacacggccgggtgggacacccgcatcaccgaggacgacctgcacaacgaggagaagatcacccagcagatggacccggagcaccggcagctcgccaacgcgatcttcaagctgacgtaccagaacaaggtggtcaaggtgcagcgccccacccccaccggcaccgtgatggacatcatctcccggaaggaccagcgcggcagcgggcaggtcggcacctacgggctgaacacgttcaccaacatggaggcccagctcatccggcagatggagggcgagggggtgctgaccaaggccgacctggagaacccccacctctccgagaagaagatcacccagtggctggagacgaagggcgtggagcgcctgaagcggatggccatcagcggcgacgactgcgtcgtgaagccgatcgacgaccgcttcgccaacgcgctcctggccctgaacgacatggggaaggtgcggaaggacatgccccagtggcagccctccaagggctggcacgactggcagcaggtccccttctgcagccaccacttccacgagctcatcatgaaggacgggcgcaagctggtggtgccgtgccggccccaggacgagctgatcggccgcgcccggatctcccagggggccggctggagcctccgcgagaccgcgtgcctgggcaaggcctacgcccagatgtggtccctgatgtacttccaccgccgggacctccgcctggccagcaacgccatctgctccgcggtccccgtgcactgggtgcccaccagccggaccacgtggagcatccacgcccaccaccagtggatgaccaccgaggacatgctgaccgtctggaaccgcgtgtggatcgaggacaacccgtggatggaggacaagacgcccgtgaccacctgggagaacgtcccctacctcgggaagcgggaggaccagtggtgcggctccctgatcgggctgaccagccgcgccacgtgggcccagaacatccccaccgccatccagcaggtccggtccctcatcggcaacgaggagttcctggactacatgccgagcatgaagcgcttccggaaggaggaggagtccgagggggcgatctggtga

SEQ ID NO: 10139 - RNA, 9873 nt, synthetic construct
  misc_feature 1..9873: note = derived and/or modified CDS sequence (opt1) from DENV-3__EU596493__SS-prME
  source 1..9873: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacccgcacccagacctggatgagcgccgagggcgcctggcggcaggtcgagaaggtcgagacctgggcgctgcgccacccggggttcacgatcctcgccctgttcctggcccactacatcggcacctccctcacccagaaggtggtgatcttcgtcctgctgatgctcgtgacccccagcatgacgatgcggtgcgtgggggtcggcaaccgcgacttcgtggagggcctgtccggggccacctgggtggacgtcgtgctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtcctgccggaggagcaggaccagaactacgtgtgcaagcacacgtacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcaccgtgcacacgggggaccagcaccaggtcggcaacgagacccagggggtgaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtcaccttcaagaacgcccacgcgaagaagcaggaggtggtggtcctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtgctgaagaaggaggtgtccgagacgcagcacgggaccatcctcatcaaggtcgagtacaagggcgaggacgccccgtgcaagatccccttcagcaccgaggacgggcagggcaaggcccacaacggccgcctgatcaccgccaaccccgtggtgacgaagaaggaggagcccgtcaacatcgaggcggagccgcccttcggggagagcaacatcgtgatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgcggtggtccaggccgacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgcgggcgcctgggagaacggggtgtgcggcatccgcagcacgacccggatggagaacctgctgtggaagcaggtcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgcggtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgcgggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgcgctgatcgccaccttcaagatccagcccttcctggccctcgggttcttcctgcgcaagctgaccagccgggagaacctcctgctgggcgtcggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtggcgtggcgcacggccaccctgatcctcgccggggtcagcctgctgccggtgtgccagtccagctccatgcggaagtccgactggctccccatgaccgtggccgccatgggcgtgccgcccctcccgctgttcatcttctccctcaaggacaccctgaagcgccgcagctggcccctgaacgagggggtgatggcggtgggcctcgtctccatcctggccagctccctgctccggaacgacgtgcccatggccggccccctggtggccgggggcctgctcatcgcctgctacgtcatcacggggaccagcgcggacctgaccgtggagaaggccgccgacgtgacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcatcttcccgtactccatccccgcgaccctgctcgtgtggcacacctggcagaagcagacccggcgcagcggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggccagcgtgaagaaggacctgatctcctacggcgggggctggcgcctcaacgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggcagccccatcatcaaccgggagggcaaggtcgtggggctgtacggcaacggggtggtcaccaagaacggcgggtacgtgtccggcatcgcccagacgaacgcggagccggacggccccacccccgagctggaggaggagatgttcaagaagcgcaacctcaccatcatggacctgcaccccgggagcggcaagacccggaagtacctgccggccatcgtgcgcgaggccatcaagcggcgcctccggacgctgatcctggcccccacccgcgtcgtggccgcggagatggaggaggccctcaaggggctgcccatccggtaccagaccaccgccacgaagtccgagcacaccggccgcgagatcgtggacctgatgtgccacgccaccttcaccatgcggctcctgagccccgtccgcgtgccgaactacaacctgatcatcatggacgaggcccacttcacggaccccgcgtccatcgccgcccgggggtacatcagcacccgcgtgggcatgggcgaggccgcggccatcttcatgaccgccacgccgcccgggacggccgacgccttcccgcagtccaacgcgcccatccaggacgaggagcgcgacatccccgagcggagctggaactccggcaacgagtggatcaccgacttcgccgggaagaccgtctggttcgtgcccagcatcaaggccggcaacgacatcgccaactgcctccgcaagaacgggaagaaggtgatccagctgtcccggaagaccttcgacacggagtaccagaagaccaagctgaacgactgggacttcgtcgtgaccaccgacatcagcgagatgggcgccaacttcaaggcggaccgcgtgatcgacccgcggcgctgcctcaagcccgtcatcctgacggacggccccgagcgggtgatcctggccgggcccatgccggtgaccgccgcctccgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagacgttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctactccgacccgctggcgctcaaggagttcaaggacttcgccgccggccgcaagagcatcgccctggacctggtcacggagatcgggcgcgtgccctcccacctcgcccaccggacccgcaacgcgctggacaacctggtgatgctccacaccagcgagcacggcgggaaggcctaccggcacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcgcacgccccaggacaaccagctggcctacgtggtgatcgggatcctcacgctggccgcgatcatcgccgccaacgagatgggcctgctcgagaccaccaagcgggacctgggcatgtccaaggagccgggggtcgtgagccccacctcctacctggacgtggacctccaccccgccagcgcgtggacgctgtacgccgtcgccaccaccgtgatcacccccatgctgcgccacacgatcgagaactccaccgccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtcatctacgactccaagttcgagaagcagctgggccaggtgatgctcctggtgctgtgcgccgtccagctcctgctgatgcggaccagctgggccctctgcgaggcgctgaccctggccaccggccccatcacgaccctctgggagggctcccccgggaagttctggaacaccaccatcgccgtgagcatggccaacatcttccgcggctcctacctggccggggcgggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagatcacgcaccacgccgtgagccggggctccgccaagctgcagtggttcgtggagcgcaacatggtcatcccggaggggcgggtgatcgacctcggctgcgggcgcggcgggtggagctactactgcgcgggcctgaagaaggtgaccgaggtccggggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccaccgtgatcgagcacctggagcggctccagcgcaagtacggcgggatgctggtccggaaccccctgtcccgcaacagcacgcacgagatgtactggatctccaacggcaccgggaacatcgtggccagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtcgtgaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggactccgccaaggccgcggtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcgcagctcatccggcagatggagggcgagggggtgctgaccaaggccgacctggagaacccccacctcagcgagaagaagatcacccagtggctggagacgaagggcgtggagcgcctgaagcggatggccatctccggcgacgactgcgtcgtgaagccgatcgacgaccgcttcgccaacgccctcctggcgctgaacgacatggggaaggtgcggaaggacatcccccagtggcagcccagcaagggctggcacgactggcagcaggtccccttctgctcccaccacttccacgagctcatcatgaaggacgggcgcaagctggtggtgccgtgccggccccaggacgagctgatcggccgcgcccggatcagccagggggccggctggtccctccgcgagaccgcctgcctgggcaaggcgtacgcccagatgtggagcctgatgtacttccaccgccgggacctccgcctggcctccaacgccatctgcagcgccgtccccgtgcactgggtgcccacctcccggaccacgtggagcatccacgcgcaccaccagtggatgaccaccgaggacatgctgaccgtctggaaccgcgtgtggatcgaggacaacccgtggatggaggacaagacgcccgtgaccacctgggagaacgtcccctacctcgggaagcgggaggaccagtggtgcggcagcctgatcgggctgacctcccgcgccacgtgggcccagaacatccccaccgccatccagcaggtccggagcctcatcggcaacgaggagttcctggactacatgccgtccatgaagcgcttccggaaggaggaggagagcgagggggccatctggtga

SEQ ID NO: 10140 - RNA, 9873 nt, synthetic construct
  misc_feature 1..9873: note = derived and/or modified CDS sequence (opt1) from DENV-3__EU596494__SS-prME
  source 1..9873: mol_type = other RNA
accagcctgtgcctcatgatgatcctgcccgccgccctggccttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtcgcgctcgcgccccacgtgggcatggggctggacacccgcacccagacctggatgagcgccgagggcgcctggcggcaggtcgagaaggtcgagacctgggcgctgcgccacccggggttcacgatcctcgccctgttcctggcccactacatcggcacctccctcacccagaaggtggtgatcttcgtcctgctgatgctcgtgacccccagcatgacgatgcggtgcgtgggggtcggcaaccgcgacttcgtggagggcctgtccggggccacctgggtggacgtcgtgctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtcctgccggaggagcaggaccagaactacgtgtgcaagcacacgtacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcaccgtgcacacgggggaccagcaccaggtcggcaacgagacccagggggtgaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtcaccttcaagaacgcccacgcgaagaagcaggaggtggtggtcctggggtcccaggagggcgccatgcacaccgccctcaccgggagcacggagatccagaactccggcgggaccagcatcttcgccggccacctgaagtgccggctgaagatggacaagctcgagctgaagggcatgtcctacgccatgtgcaccaacaccttcgtgctgaagaaggaggtgagcgagacgcagcacgggaccatcctcatcaaggtcgagtacaagggcgaggacgcgccgtgcaagatccccttcagcaccgaggacgggcagggcaaggcccacaacggccgcctgatcaccgccaaccccgtggtgacgaagaaggaggagcccgtcaacatcgaggccgagccgcccttcggggagtccaacatcgtgatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtgggcggggtcctcaactccctgggcaagatggtgcaccagatcttcgggagcgcctacaccgccctgttctccggcgtgagctgggtcatgaagatcggcatcggggtgctcctgacgtggatcggcctgaactccaagaacaccagcatgtccttcagctgcatcgccatcgggatcatcaccctctacctgggcgccgtggtccaggcggacaccgggtgcgtgatcaactggaagggcaaggagctgaagtgcggctccgggatcttcgtgacgaacgaggtccacacctggaccgagcagtacaagttccaggccgacagccccaagcgcctcgccaccgccatcgccggcgcgtgggagaacggggtgtgcggcatccgctccacgacccggatggagaacctgctgtggaagcaggtcgccaacgagctcaactacatcctgtgggagaacaacatcaagctgaccgtcgtggtgggggacatcatcggcgtcctcgagcagggcaagcgcaccctgacgccccagccgatggagctgaagtacagctggaagacctgggggaaggccaagatcgtgaccgccgagacccagaactccagcttcatcatcgacggccccaacacgcccgagtgcccctccgcgagccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgcggacatgggctactggatcgagtcccagaagaacgggagctggaagctggagaaggcctccctgatcgaggtgaagacctgcacgtggcccaagagccacaccctctggtccaacggcgtcctggagagcgacatgatcatccccaagtccctggccgggcccatcagccagcacaactaccggccgggctaccacacccagaccgccgggccctggcacctcggcaagctggagctggacttcaactactgcgagggcacgaccgtggtgatcaccgagaactgcgggacccgcggcccctccctccggacgaccaccgtcagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtgagcgccggctccgggaaggtcgacaacttcacgatgggcgtgctgtgcctcgcgatcctgttcgaggaggtgatgcgggggaagttcggcaagaagcacatgatcgccggggtcttcttcaccttcgtgctgctcctgagcggccagatcacctggcgcgacatggcccacaccctgatcatgatcggctccaacgccagcgaccggatggggatgggcgtgacgtacctcgccctgatcgcgaccttcaagatccagcccttcctggccctcgggttcttcctgcgcaagctgaccagccgggagaacctcctgctgggcgtcggcctcgccatggccaccacgctgcagctgcccgaggacatcgagcagatggcgaacgggatcgccctcggcctgatggccctgaagctcatcacccagttcgagacctaccagctgtggaccgccctgatctccctcacgtgcagcaacaccatcttcaccctgaccgtggcctggcgcacggcgaccctgatcctcgccggggtctccctgctgccggtgtgccagagctccagcatgcggaagtccgactggctccccatgaccgtggccgccatgggcgtgccgcccctcccgctgttcatcttcagcctcaaggacaccctgaagcgccgctcctggcccctgaacgagggggtgatggccgtgggcctcgtcagcatcctggcgtccagcctgctccggaacgacgtgcccatggccggccccctggtggccgggggcctgctcatcgcctgctacgtcatcacggggacctccgccgacctgaccgtggagaaggcggccgacgtgacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccggcgctccggcgtgctgtgggacgtccccagcccgcccgagacgcagaaggcggagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggcctccgtgaagaaggacctgatcagctacggcgggggctggcgcctcagcgcccagtggcagaagggggaggaggtccaggtgatcgcggtggagcccggcaagaaccccaagaacttccagaccatgcccggcaccttccagaccacgaccggggagatcggcgccatcgccctggacttcaagcccgggacctccggcagccccatcatcaaccgggagggcaaggtcgtggggctgtacggcaacggggtggtcaccaagaacggcgggtacgtgtccggcatcgcccagacgaacgccgagccggacggccccacccccgagctggaggaggagatgttcaagaagcgcaacctcaccatcatggacctgcaccccgggagcggcaagacccggaagtacctgccggcgatcgtgcgcgaggccatcaagcggcgcctccggacgctgatcctggcccccacccgcgtcgtggccgccgagatggaggaggcgctcaaggggctgcccatccggtaccagaccaccgccacgcgctccgagcacaccggccgggagatcgtggacctgatgtgccacgccaccttcaccatgcgcctcctgagccccgtccgggtgccgaactacaacctgatcatcatggacgaggcccacttcacggaccccgcctccatcgcggcccgcgggtacatcagcacccgcgtgggcatgggcgaggccgccgcgatcttcatgaccgccacgccgcccgggacggccgacgccttcccgcagtccaacgcccccatccaggacgaggagcgggacatccccgagcgcagctggaactccggcaacgagtggatcaccgacttcgcggggaagaccgtctggttcgtgcccagcatcaaggccggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccgctggctggacgcccggacctactccgacccgctggccctcaaggagttcaaggacttcgcggccggccgcaagagcatcgccctggacctggtcacggagatcgggcgggtgcccagccacctcgcccaccgcacccggaacgccctggacaacctggtgatgctccacacctccgagcacggcgggaaggcgtaccgccacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcacgctggccgccatcatcgcggccaacgagatgggcctgctcgagaccaccaagcgcgacctgggcatgtccaaggagccgggggtcgtgagccccacctcctacctggacgtggacctccaccccgccagcgcctggacgctgtacgcggtcgccaccaccgtgatcacccccatgctgcggcacacgatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgcgatcatcggccccggcctccaggccaaggccacccgcgaggcccagaagcggaccgccgcggggatcatgaagaacccgaccgtggacggcatcatgacgatcgacctggaccccgtcatctacgactccaagttcgagaagcagctgggccaggtgatgctcctggtgctgtgcgccgtccagctcctgctgatgcgcaccagctgggccctctgcgaggccctgaccctggcgaccggccccatcacgaccctctgggagggctcccccgggaagttctggaacaccaccatcgccgtgagcatggccaacatcttccggggctcctacctggccggggccggcctggcgttcagcatcatgaagtccgtggggacgggcaagcgcggcaccgggtcccagggcgagaccctcggggagaagtggaagaagaagctgaaccagctgagccggaaggagttcgacctctacaagaagtccggcatcaccgaggtcgaccgcaccgaggccaaggaggggctgaagcggggcgagatcacgcaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccgcaccatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacgcacgagatgtactggatctccaacggcaccgggaacatcgtggcgagcgtgaacatggtctcccgcctcctgctgaaccggttcaccatgacccaccgccggccgacgatcgagaaggacgtggacctcggcgccggcacccgccacgtgaacgccgagcccgagacccccaacatggacgtcatcggggagcggatcaagcgcatcaaggaggagcacaacagcacctggcactacgacgacgagaacccgtacaagacgtgggcctaccacggctcctacgaggtgaaggccaccgggagcgcgagctccatgatcaacggcgtcgtgaagctgctgaccaagccctgggacgtggtccccatggtgacccagatggccatgacggacaccacccccttcgggcagcagcgggtgttcaaggagaaggtcgacacccgcacgccgcggagcatgcccggcacccgccgggtgatgggcatcaccgccgagtggctctggcgcaccctggggcggaacaagaagccccgcctgtgcacgcgcgaggagttcaccaagaaggtgcggaccaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacacggccgggtgggacacccggatcaccgaggacgacctgcacaacgaggagaagatcacccagcagatggacccggagcaccgccagctcgccaacgccatcttcaagctgacgtaccagaacaaggtggtcaaggtgcagcggcccacccccaccggcaccgtgatggacatcatcagccgcaaggaccagcggggctccgggcaggtcggcacctacgggctgaacacgttcaccaacatggaggcccagctcatccgccagatggagggcgagggggtgctgaccaaggcggacctggagaacccccacctcagcgagaagaagatcacccagtggctggagacgaagggcgtggagcggctgaagcgcatggccatctccggcgacgactgcgtcgtgaagccgatcgacgaccggttcgccaacgccctcctggccctgaacgacatggggaaggtgcgcaaggacatcccccagtggcagcccagcaagggctggcacgactggcagcaggtccccttctgctcccaccacttccacgagctcatcatgaaggacgggcggaagctggtggtgccgtgccgcccccaggacgagctgatcggccgggcgcgcatcagccagggggccggctggtccctccgcgagaccgcctgcctgggcaaggcctacgcgcagatgtggagcctgatgtacttccaccggcgcgacctccggctggcctccaacgccatctgcagcgccgtccccgtgcactgggtgcccaccagccgcaccacgtggtccatccacgcccaccaccagtggatgaccaccgaggacatgctgaccgtctggaaccgggtgtggatcgaggacaacccgtggatggaggacaagacgcccgtgaccacctgggagaacgtcccctacctcgggaagcgcgaggaccagtggtgcggcagcctgatcgggctgacctcccgggcgacgtgggcccagaacatccccaccgccatccagcaggtccgcagcctcatcggcaacgaggagttcctggactacatgccgtccatgaagcggttccgcaaggaggaggagagcgagggggccatctggtga

SEQ ID NO: 10141 - RNA, 9873 nt, synthetic construct
  misc_feature 1..9873: note = derived and/or modified CDS sequence (opt1) from DENV-3__EU687218__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagaagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10142 - RNA, 9873 nt, synthetic construct
  misc_feature 1..9873: note = derived and/or modified CDS sequence (opt1) from DENV-3__EU726772__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaagggccgcaaggacatcccccagtggcagcccagcaaggggtggcacgactggcagcaggtcccgttctgctcccaccacttccacgagctcatcatgaaggacggccggaagctggtggtcccctgccgcccccaggacgagctgatcgggcgggcccgcatcagccagggcgcgggctggtccctccgggagaccgcctgcctggggaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcggcaagcgcgaggaccagtggtgcgggagcctgatcggcctgacctcccgggccacgtgggcgcagaacatcccgaccgccatccagcaggtccgcagcctcatcgggaacgaggagttcctggactacatgccctccatgaagcggttccgcaaggaggaggagagcgagggcgccatctggtga

SEQ ID NO: 10143 - RNA, 9873 nt, synthetic construct
  misc_feature 1..9873: note = derived and/or modified CDS sequence (opt1) from DENV-3__FJ182013__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacgtgggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaagatccccttcagcaccgaggacgggcagggcaaggcgcacaacggccgcctgatcacggccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatggccgtggccgccatgggcgtgccgcccctcccgctgttcatcttcagcctcaaggacaccctgaagcgccgctcctggcccctgaacgagggggtgatggccgtgggcctcgtcagcatcctggcgtccagcctgctccggaacgacgtgcccatggccggccccctggtggccgggggcctgctcatcgcctgctacgtcatcacggggacctccgccgacctgaccgtggagaaggcggccgacgtgacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggcggagctggaggagggggtgtaccgcatcaagcagcagggcatcttcgggaagacccaggtgggcgtcggggtgcagaaggagggcgtgttccacaccatgtggcacgtcacccggggcgccgtgctcacgtacaacgggaagcgcctggagcccaactgggcctccgtgaagaaggacctgatcagctacggcgggggctggcggctctccgcccagtggcagaagggggaggaggtccaggtgatcgcggtggagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggcgatcgtgcgggaggccatcaagcgccggctccgcacgctgatcctggcccccacccgggtcgtggccgccgagatggaggaggcgctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcctccatcgcggcccgcgggtacatcagcacccgggtgggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtctggttcgtgcccagcatcaaggccggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggccgaccgggtgatcgacccgcgccggtgcctcaagcccgtcatcctgacggacggccccgagcgcgtgatcctggcggggcccatgccggtgaccgccgcctccgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagacgttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgcggccggccgcaagagcatcgccctggacctggtcacggagatcgggcgggtgccctcccacctcgcccaccgcacccggaacgccctggacaacctggtgatgctccacaccagcgagcacggcgggaaggcgtaccgccacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtgctggagttcttcatgatggtcctcctgatccccgagcccgagaagcagcggacgccccaggacaaccagctggcctacgtggtgatcgggatcctcacgctggccgccatcatcgcggccaacgagatgggcctgctcgagaccaccaagcgcgacctgggcatgtccaaggagccgggggtcgtgagccccacctcctacctggacgtggacctccaccccgccagcgcctggacgctgtacgcggtcgccaccaccgtgatcacccccatgctgcggcacacgatcgagaactccaccgccaacgtgagcctcgccgccatcgcgaaccaggccgtcgtgctgatgggcctggacaaggggtggccgatctccaagatggacctcggcgtgcccctgctggccctcgggtgctacagccaggtcaaccccctgaccctgaccgccgccgtgctcctgctgatcacgcactacgcgatcatcggccccggcctccaggccaaggccacccgcgaggcccagaagcggaccgccgcggggatcatgaagaacccgaccgtggacggcatcatgacgatcgacctggaccccgtcatctacgactccaagttcgagaagcagctgggccaggtgatgctcctggtgctgtgcgccgtccagctcctgctgatgcgcaccagctgggccctctgcgaggccctgaccctggcgaccggccccatcacgaccctctgggagggctcccccgggaagttctggaacaccaccatcgccgtgagcatggccaacatcttccggggctcctacctggccggggccggcctggcgttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtcgaccgcaccgaggccaaggaggggctgaagcggggcgagatcacgcaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacgcacgagatgtactggatctccaacggcaccgggaacatcgtggcgagcgtgaacatggtctcccgcctcctgctgaaccggttcaccatgacccaccgccggccgacgatcgagaaggacgtggacctcggcgccggcacccgccacgtgaacgccgagcccgagacccccaacatggacgtcatcggggagcggatcaagcgcatcaaggaggagcacaacagcacctggcactacgacgacgagaacccgtacaagacgtgggcctaccacggctcctacgaggtgaaggccaccgggagcgcgtccagcatgatcaacggcgtcgtgaagctgctgaccaagccctgggacgtggtccccatggtgacccagatggccatgacggacaccacccccttcgggcagcagcgggtgttcaaggagaaggtcgacacccgcacgccgcggagcatgcccggcacccgccgggtgatgggcatcaccgccgagtggctctggcgcaccctggggcggaacaagaagccccgcctgtgcacgcgggaggagttcaccaagaaggtgcgcaccaacgccgcgatgggcgccgtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacacggccgggtgggacacccggatcaccgaggacgacctgcacaacgaggagaagatcacccagcagatggacccggagcaccgccagctcgccaacgccatcttcaagctgacgtaccagaacaaggtggtcaaggtgcagcggcccacccccaccggcaccgtgatggacatcatcagccgcaaggaccagcggggctccgggcaggtcggcacctacgggctgaacacgttcaccaacatggaggcccagctcatccgccagatggagggcgagggggtgctgagcaaggcggacctggagaacccccacctcccggagaagaagatcacccagtggctggagaccaagggcgtggagcggctgaagcgcatggccatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcgcgcatcagccagggggccggctggtccctccgggagacggcctgcctgggcaaggcctacgcgcagatgtggagcctgatgtacttccaccgccgcgacctccggctggcctccaacgccatctgcagcgccgtccccgtgcactgggtgccgacctcccgcaccacctggagcatccacgcccaccaccagtggatgacgaccgaggacatgctgaccgtctggaaccgggtgtggatcgaggacaacccctggatggaggacaagacccccgtgacgacctgggagaacgtcccctacctcgggaagcgcgaggaccagtggtgcggcagcctgatcgggctgacctcccgggcgacctgggcccagaacatcccgacggccatccagcaggtccgcagcctcatcggcaacgaggagttcctggactacatgccctccatgaagcggttccgcaaggaggaggagagcgagggggccatctggtga

SEQ ID NO: 10144 - RNA, 9873 nt, synthetic construct
  misc_feature 1..9873: note = derived and/or modified CDS sequence (opt1) from DENV-3__EU781136__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtggtgaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacaccagcgagcacggcgggaaggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgcgggcacccgccacgtgaacgccgagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggcgatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgggaggagttcaccaagaaggtgcgcaccaacgccgccatgggcgcggtcttcacggaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10145 - RNA, 9873 nt, synthetic construct
  misc_feature 1..9873: note = derived and/or modified CDS sequence (opt1) from DENV-3__EU781137__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcacgctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgtccaaggagccgggggtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgacgctggccaccggccccatcaccaccctctgggagggctcccccgggaagttctggaacacgaccatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggccgacctggagaacccccacctcccggagaagaagatcacgcagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcgtcatgaaggacgggcggaagctggtggtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtccccgtgcactgggtgccgacctcccgcacgacctggagcatccacgcccaccaccagtggatgaccaccgaggacatgctgacggtctggaaccgggtgtggatcgaggacaacccctggatggaggacaagacccccgtgaccacctgggagaacgtcccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10146 - RNA, 9873 nt, synthetic construct
  misc_feature 1..9873: note = derived and/or modified CDS sequence (opt1) from DENV-3__EU726773__SS-prME
  source 1..9873: mol_type = other RNA
accagcctgtgcctcatgatgatcctgcccgcggcgctggcgttccacctcaccagccgcgacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagaaggacatccccgagcgcagctggaactccggcaacgagtggatcaccgacttcgccgggaagaccgtctggttcgtgcccagcatcaaggccggcaacgacatcgcgaactgcctccgcaagaacgggaagaaggtgatccagctgtcccggaagacgttcgacaccgagtaccagaagaccaagctgaacgactgggacttcgtcgtgaccacggacatcagcgagatgggcgccaacttcaaggccgaccgcgtgatcgacccgcggcgctgcctcaagcccgtcatcctgaccgacggccccgagcgggtgatcctggccgggcccatgccggtgaccgccgcgtccgccgcccagcgccggggccgcgtcgggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcccacaaggtggcgagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccggacgtactccgacccgctggccctcaaggagttcaaggacttcgccgccggccgcaagagcatcgcgctggacctggtcaccgagatcgggcgcgtgccctcccacctcgcccaccggacccgcaacgccctggacaacctggtgatgctccacaccagcgagcacggcgggaaggcctaccggcacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcgcacgccccaggacaaccagctggcgtacgtggtgatcgggatcctcaccctggccgccatcatcgccgccaacgagatgggcctgctcgagaccaccaagcgggacctgggcatgtccaaggagccgggggtcgtgagccccacgtcctacctggacgtggacctccaccccgcgagcgcctggaccctgtacgccgtcgccaccaccgtgatcacgcccatgctgcgccacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgggaggcccagaagcgcaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcggaccagctgggcgctctgcgaggccctgaccctggccacgggccccatcaccaccctctgggagggctcccccgggaagttctggaacaccacgatcgccgtgagcatggcgaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtcgaccggacggaggccaaggaggggctgaagcgcggcgagatcacccaccacgcggtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccggggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccgcaccatccgggtgctgaagatggtcgagccgtggctcaagaacaaccagttctgcatcaaggtgctgaacccctacatgcccacggtgatcgagcacctggagcgcctccagcgcaagcacggcgggatgctggtccggaaccccctgtcccgcaacagcacccacgagatgtactggatctccaacggcaccgggaacatcgtggccagcgtgaacatggtctcccggctcctgctgaaccgcttcaccatgacgcaccggcgcccgaccatcgagaaggacgtggacctcggcgccggcacccggcacgtgaacgcggagcccgagacccccaacatggacgtcatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggccatgaccgacaccacccccttcgggcagcagcgcgtgttcaaggagaaggtcgacacgcggaccccgcgcagcatgcccggcacccggcgcgtgatgggcatcaccgcggagtggctctggcggacgctggggcgcaacaagaagccccggctgtgcacccgcgaggagttcaccaagaaggtgcggaccaacgccgccatgggcgccgtcttcacggaggagaaccagtgggactccgcgaaggccgccgtggaggacgaggacttctggatcctcgtggaccgcgagcgcgagctgcacaagctggggaagtgcggcagctgcgtctacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgccgggtgggacacccgcatcaccgaggacgacctgcacaacgaggagaagatcacgcagcagatggacccggagcaccggcagctcgcgaacgccatcttcaagctgacctaccagaacaaggtggtcaaggtgcagcgccccacccccaccggcaccgtgatggacatcatcagccggaaggaccagcgcggctccgggcaggtcggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtggagcgcctgaagcggatggccatctccggcgacgactgcgtcgtgaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagaccgcgtgcctgggcaaggcctacgcccagatgtggagcctgatgtacttccaccggcgcgacctccgcctggcctccaacgcgatctgcagcgccgtccccgtgcactgggtgccgacctcccggaccacgtggagcatccacgcccaccaccagtggatgaccaccgaggacatgctgaccgtctggaaccgcgtgtggatcgaggacaacccctggatggaggacaagacgcccgtgaccacctgggagaacgtcccctacctcgggaagcgggaggaccagtggtgcggcagcctgatcgggctgacctcccgcgccacgtgggcccagaacatcccgaccgcgatccagcaggtccggagcctcatcggcaacgaggagttcctggactacatgccctccatgaagcgcttccggaaggaggaggagagcgagggggccatctggtga

SEQ ID NO: 10147 - RNA, 9873 nt, synthetic construct
  misc_feature 1..9873: note = derived and/or modified CDS sequence (opt1) from DENV-3__EU726774__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatggtgggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtcggcctcgccatggccacgaccctgcagctgcccgaggacatcgagcagatggccaacgggatcgcgctcggcctgatggccctgaagctcaccacccagttcgagacgtaccagctgtggaccgccctgatcagcctgacctgctccaacaccatcttcacgctgaccgtggcctggcgcaccgccaccctgatcctcgcgggggtcagcctgctgccggtgtgccagtccagctccatgcggaagacggactggctccccatgaccgtggccgccatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacgtccgccgacctgaccgtggagaaggccgcggacgtgacctgggaggaggaggccgagcagaccggcgtcagccacaacctgatgatcaccgtggacgacgacgggacgatgcgcatcaaggacgacgagaccgagaacatcctcaccgtgctgctgaagaccgccctcctgatcgtctccggcatcttcccgtacagcatccccgccacgctgctcgtgtggcacacctggcagaagcagacccagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagacgatgcccggcaccttccagaccaccacgggggagatcggcgcgatcgccctggacttcaagcccgggaccagcggcagccccatcatcaaccgcgagggcaaggtcgtggggctgtacggcaacggggtggtcaccaagaacggcgggtacgtgtccggcatcgcccagaccaacgccgagccggacggccccacgcccgagctggaggaggagatgttcaagaagcggaacctcaccatcatggacctgcaccccgggagcggcaagacccgcaagtacctgccggccatcgtgcgggaggcgatcaagcgccggctccgcaccctgatcctggcccccacgcgggtcgtggccgccgagatggaggaggccctcaaggggctgcccatccgctaccagaccaccgcgaccaagtccgagcacacgggccgggagatcgtggacctgatgtgccacgccaccttcaccatgcgcctcctgagccccgtccgggtgccgaactacaacctgatcatcatggacgaggcccacttcaccgaccccgcctccatcgccgcgcgcgggtacatcagcacgcgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcacggacttcgccgggaagaccgtctggttcgtgcccagcatcaaggcgggcaacgacatcgccaactgcctccggaagaacgggaagaaggtgatccagctgtcccgcaagaccttcgacaccgagtaccagaagacgaagctgaacgactgggacttcgtcgtgaccaccgacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcacgggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgccgcgggccgcaagagcatcgccctggacctggtcaccgagatcgggcgggtgccctcccacctcgcccaccgcacgcggaacgccctggacaacctggtgatgctccacaccagcgagcacggcgggaaggcctaccgccacgcggtcgaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagacgaccaagcgcgacctgggcatgtccaaggagccgggggtcgtgagccccacctcctacctggacgtggacctccaccccgccagcgcctggaccctgtacgccgtcgcgacgaccgtgatcacccccatgctgcggcacaccatcgagaactccacggccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacccactacgccatcatcggccccggcctccaggcgaaggccacgcgcgaggcccagaagcggaccgccgccgggatcatgaagaacccgaccgtggacggcatcatgaccatcgacctggaccccgtcatctacgactccaagttcgagaagcagctgggccaggtgatgctcctggtgctgtgcgcggtccagctcctgctgatgcgcacgagctgggccctctgcgaggccctgaccctggccaccggccccatcaccacgctctgggagggctcccccgggaagttctggaacaccaccatcgcggtgagcatggccaacatcttccggggctcctacctggccggggccggcctggccttcagcatcatgaagtccgtggggaccggcaagcgcggcaccgggagccagggcgagacgctcggggagaagtggaagaagaagctgaaccagctgagccggaaggagttcgacctctacaagaagtccggcatcaccgaggtcgaccgcaccgaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgacggaggtccgcggctacaccaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccacggtggaggagagccggaccatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcacggggaacatcgtggccagcgtgaacatggtctcccgcctcctgctgaaccggttcaccatgacccaccgccggccgaccatcgagaaggacgtggacctcggcgcgggcacgcgccacgtgaacgccgagcccgagacccccaacatggacgtcatcggggagcggatcaagcgcatcaaggaggagcacaacagcacctggcactacgacgacgagaacccgtacaagacctgggcctaccacggctcctacgaggtgaaggccacggggagcgcctccagcatgatcaacggcgtcgtgaagctgctgaccaagccctgggacgtggtccccatggtgacccagatggcgatgaccgacacgacccccttcgggcagcagcgggtgttcaaggagaaggtcgacacccgcaccccgcggagcatgcccggcacgcgccgggtgatgggcatcaccgccgagtggctctggcgcaccctggggcggaacaagaagccccgcctgtgcacccgggaggagttcacgaagaaggtgcgcaccaacgccgccatgggcgcggtcttcaccgaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtggtcaaggtgcagcggcccacccccacgggcaccgtgatggacatcatcagccgcaaggaccagcggggctccgggcaggtcggcacctacgggctgaacaccttcacgaacatggaggcccagctcatccgccagatggagggcgagggggtgctgagcaaggccgacctggagaacccccacctcccggagaagaagatcacccagtggctggagaccaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtccccgtgcactgggtgccgacgtcccgcaccacctggagcatccacgcccaccaccagtggatgaccacggaggacatgctgaccgtctggaaccgggtgtggatcgaggacaacccctggatggaggacaagacccccgtgaccacgtgggagaacgtcccctacctcgggaagcgcgaggaccagtggtgcggcagcctgatcgggctgacctcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10148 - RNA, 9873 nt, synthetic construct
  misc_feature 1..9873: note = derived and/or modified CDS sequence (opt1) from DENV-3__EU687219__SS-prME
  source 1..9873: mol_type = other RNA
accagcctctgcctcatgatgatcctgcccgccgccctggccttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacccgcacccagacctggatgagcgccgagggcgcctggcggcaggtcgagaaggtcgagacctgggcgctgcgccacccggggttcaccatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacatggggtgcgtgatcaactggaagggcaaggagctgaagtgcggcagcgggatcttcgtgaccaacgaggtccacacgtggaccgagcagtacaagttccaggccgactcccccaagcgcctcgccaccgccatcgccggcgcgtgggagaacggggtgtgcggcatccgcagcaccacgcggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacgtgggggaaggccaagatcgtcaccgccgagacccagaacagctccttcatcatcgacggccccaacacccccgagtgccccagcgtgtcccgggcgtggaacgtgtgggaggtcgaggactacgggttcggcgtgttcacgaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacctggccgaagtcccacacgctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcaccacggtggtgatcaccgagaactgcgggacccgcggccccagcctccggaccacgaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcttcttcacgttcgtgctgctcctgtccggccagatcacctggcgcgacatggcccacaccctgatcatgatcggcagcaacgcctccgaccggatggggatgggcgtgacctacctcgccctgatcgccacgttcaagatccagcccttcctggcgctcgggttcttcctgcgcaagctgaccagccgggagaacctcctgctgggcgtcggcctcgccatggccaccaccctgcagctgcccgaggacatcgagcagatggccaacgggatcgcgctcggcctgatggccctgaagctcatcacgcagttcgagacctaccagctgtggaccgccctgatcagcctgacctgctccaacacgatcttcaccctgaccgtggcctggcgcaccgccacgctgatcctcgcgggggtcagcctgctgccggtgtgccagtccagctccatgcggaagaccgactggctccccatgaccgtggccgccatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcacggggacctccgccgacctgaccgtggagaaggccgcggacgtgacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgccaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggcagccccatcatcaaccgcgagggcaaggtcgtggggctgtacggcaacggggtgatcaccaagaacggcgggtacgtctccggcatcgcccagacgaacgccgagccggacggccccacccccgagctggaggaggagatgttcaagaagcggaacctcaccatcatggacctgcaccccgggagcggcaagacccgcaagtacctgccggccatcgtgcgggaggcgatcaagcgccggctccgcacgctgatcctggcccccacccgggtggtcgccgccgagatggaggaggccctcaaggggctgcccatccgctaccagaccaccgcgacgaagtccgagcacaccggccgggagatcgtggacctgatgtgccacgccaccttcaccatgcgcctcctgagccccgtgcgggtcccgaactacaacctgatcatcatggacgaggcccacttcacggaccccgcctccatcgccgcgcgcgggtacatcagcacccgggtgggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaaggccgaccgggtgatcgacccgcgccggtgcctcaagcccgtgatcctgacggacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgccgcgggccgcaagagcatcgccctggacctggtgacggagatcgggcgggtcccctcccacctcgcccaccgcacccggaacgccctggacaacctggtgatgctccacaccagcgagcacggcgggaaggcctaccgccacgcggtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcacgctggccgccatcatcgccgcgaacgagatgggcctgctcgagaccaccaagcgcgacctgggcatgtccaaggagccgggggtggtcagccccacctcctacctggacgtggacctccaccccgccagcgcctggacgctgtacgccgtggcgaccaccgtcatcacccccatgctgcggcacacgatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgaccgccgccgtcctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtgatctacgactccaagttcgagaagcagctggggcaggtcatgctcctggtgctgtgcgcggtgcagctcctgctgatgcgcaccagctgggccctctgcgaggccctgaccctggccaccggccccatcacgaccctctgggagggctcccccgggaagttctggaacaccaccatcgcggtcagcatggccaacatcttccggggctcctacctggccggggccggcctggccttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtggaccgcaccgaggcgaaggaggggctgaagcggggcgagatcacgcaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacgcacgagatgtactggatctccaacggcaccgggaacatcgtcgccagcgtgaacatggtgtcccgcctcctgctgaaccggttcaccatgacccaccgccggccgacgatcgagaaggacgtcgacctcggcgcgggcacccgccacgtgaacgccgagcccgagacccccaacatggacgtgatcggggagcggatcaagcgcatcaaggaggagcacaacagcacctggcactacgacgacgagaacccgtacaagacgtgggcctaccacggctcctacgaggtcaaggccaccgggagcgcctccagcatgatcaacggcgtggtcaagctgctgaccaagccctgggacgtggtgcccatggtcacccagatggcgatgacggacaccacccccttcgggcagcagcgggtgttcaaggagaaggtggacacccgcacgccgcggagcatgcccggcacccgccgggtcatgggcatcaccgccgagtggctctggcgcaccctggggcggaacaagaagccccgcctgtgcacgcgggaggagttcaccaagaaggtgcgcaccaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacgtaccagaacaaggtggtgaaggtccagcggcccacccccaccggcaccgtgatggacatcatcagccgcaaggaccagcggggctccggccaggtgggcacctacgggctgaacacgttcaccaacatggaggcccagctcatccgccagatggagggcgagggggtcctgagcaaggccgacctggagaacccccacctcccggagaagaagatcacccagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagacggcctgcctgggcaaggcctacgcccagatgtggagcctgatgtacttccaccgccgcgacctccggctggcgtccaacgccatctgcagcgccgtgcccgtccactgggtgccgacctcccgcaccacctggagcatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggcagcctgatcgggctgacctcccgggccacctgggcgcagaacatcccgacggccatccagcaggtccgcagcctcatcggcaacgaggagttcctggactacatgccctccatgaagcggttccgcaaggaggaggagagcgagggggccatctggtga

SEQ ID NO: 10149 - RNA, 9873 nt, synthetic construct
  misc_feature 1..9873: note = derived and/or modified CDS sequence (opt1) from DENV-3__EU726768__SS-prME
  source 1..9873: mol_type = other RNA
accagcctgtgcctcatgatgatcctgcccgcggcgctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtctggttcgtgcccagcatcaaggccggcaacgacatcgcgaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgccgcgtccgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcccacaaggtggcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgccggccgcaagagcatcgcgctggacctggtcaccgagatcgggcgggtgccctcccacctcgcccaccgcacccggaacgccctggacaacctggtgatgctccacaccagcgagcacggcgggaaggcctaccgccacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccaccaagcgcgacctgggcatgtccaaggagccgggggtcgtgagccccacgtcctacctggacgtggacctccaccccgcgagcgcctggaccctgtacgccgtcgccaccaccgtgatcacgcccatgctgcggcacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcgcaccagctgggcgctctgcgaggccctgaccctggccacgggccccatcaccaccctctgggagggctcccccgggaagttctggaacaccacgatcgccgtgagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggccaaggaggggctgaagcggggcgagatcacccaccacgcggtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgccggcacccgccacgtgaacgcggagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgcggagtggctctggcgcacgctggggcggaacaagaagccccgcctgtgcacccgggaggagttcaccaagaaggtgcgcaccaacgccgccatgggcgccgtcttcacggaggagaaccagtgggactccgcgaaggccgccgtggaggacgaggacttctggatcctcgtggaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggccatctccggcgacgactgcgtcgtgaagcccatcgacgaccggttcgcgaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctccgggagaccgcgtgcctgggcaaggcctacgcccagatgtggagcctgatgtacttccaccgccgcgacctccggctggcctccaacgcgatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10150 - RNA, 9873 nt, synthetic construct
  misc_feature 1..9873: note = derived and/or modified CDS sequence (opt1) from DENV-3__EU687226__SS-prME
  source 1..9873: mol_type = other RNA
accagcctgtgcctgatgatgatcctgcccgccgccctggcgttccacctcaccagccgggacggcgagccgcggatgatcgtggggaagaacgagcgcggcaagagcctgctgttcaagacggccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccgtctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctgccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcacaagcagacgcagcggtccggcgtgccctgggacgtccccagcccgcccgagacccagaaggccgagctggaggagggggtgtaccgcatcaagcagcagggcatcttcgggaagacccaggtgggcgtcggggtgcagaaggagggcgtgttccactccatgtggcacgtcacccggggcgcggtgctgacgtacaacgggaagcgcctcgagcccaactgggccagcgtgaagaaggacctgatctcctacggcgggggctggcggctgagcgcccagtggcagaagggggaggaggtccaggtgatcgccgtggagcccggcaagaacccgaagaacttccagaccatgcccggcaccttccagaccacgaccggggagatcggcgcgatcgccctcgacttcaagcccgggaccagcggctccccgatcatcaaccgcgagggcaaggtcgtggggctgtacggcaacggggtggtcaccaagaacggcgggtacgtgagcggcatcgcccagacgaacgccgagcccgacggccccacccccgagctggaggaggagatgttcaagaagcggaacctgaccatcatggacctccacccggggtccggcaagacccgcaagtacctgcccgccatcgtgcgggaggcgatcaagcgccggctgcgcacgctcatcctggcccccacccgggtcgtggccgccgagatggaggaggccctgaaggggctccccatccgctaccagaccaccgcgaccaagagcgagcacaccggccgggagatcgtggacctgatgtgccacgccaccttcaccatgcgcctgctctccccggtccgggtgcccaactacaacctgatcatcatggacgaggcccacttcacggaccccgccagcatcgccgcgcgcgggtacatctccacccgggtgggcatgggcgaggccgccgccatcttcatgaccgcgacgccgcccgggacggccgacgccttcccccagagcaacgcccccatccaggacgaggagcgcgacatccccgagcgctcctggaacagcggcaacgagtggatcaccgacttcgccgggaagaccgtctggttcgtgccctccatcaaggcgggcaacgacatcgccaactgcctgcggaagaacgggaagaaggtgatccagctcagccgcaagaccttcgacacggagtaccagaagaccaagctgaacgactgggacttcgtcgtgaccaccgacatctccgagatgggcgccaacttcaaggccgaccgggtgatcgacccccgccggtgcctgaagcccgtcatcctcacggacggccccgagcgcgtgatcctggccgggccgatgcccgtgaccgcggccagcgccgcccagcggcgcggccgggtcgggcgcaacccccagaaggagaacgaccagtacatcttcaccggccagcccctgaacaacgacgaggaccacgcccactggaccgaggcgaagatgctcctggacaacatcaacaccccggaggggatcatccccgccctgttcgagcccgagcgggagaagtccgccgccatcgacggcgagtaccgcctcaagggcgagagccggaagacgttcgtggagctgatgcgccgcggggacctgcccgtctggctcgcgcacaaggtggcctccgagggcatcaagtacaccgaccgcaagtggtgcttcgacgggcagcggaacaaccagatcctggaggagaacatggacgtggagatctggaccaaggagggcgagaagaagaagctgcgcccgcggtggctcgacgcccgcacctacagcgaccccctggccctgaaggagttcaaggacttcgccgcgggccgcaagtccatcgccctcgacctggtcacggagatcgggcgggtgcccagccacctggcccaccgcacccggaacgccctcgacaacctggtgatgctgcacaccagcgagcacggcgggaaggcctaccgccacgcggtcgaggagctcccggagaccatggagacgctgctgctcctgggcctgatgatcctcctgaccgggggcgccatgctgttcctcatctccggcaaggggatcggcaagaccagcatcgggctgatctgcgtgatcgcctccagcggcatgctgtggatggccgagatccccctccagtggatcgcctccgcgatcgtgctggagttcttcatgatggtcctgctcatccccgagcccgagaagcagcggaccccgcaggacaaccagctggcctacgtggtgatcgggatcctgacgctcgccgccatcatcgccgcgaacgagatgggcctgctggagaccaccaagcgcgacctcggcatgagcaaggagcccggggtcgtgtcccccaccagctacctggacgtggacctgcaccccgcctccgcctggacgctctacgccgtcgcgaccaccgtgatcaccccgatgctgcggcacacgatcgagaacagcaccgccaacgtgtccctggccgccatcgccaaccaggcggtcgtgctcatgggcctggacaaggggtggcccatcagcaagatggacctgggcgtgcccctcctggccctggggtgctactcccaggtcaaccccctcaccctgaccgccgccgtgctgctcctgatcacgcactacgccatcatcggcccgggcctgcaggcgaaggccacccgcgaggcccagaagcggaccgccgccgggatcatgaagaaccccaccgtggacggcatcatgacgatcgacctcgaccccgtcatctacgacagcaagttcgagaagcagctgggccaggtgatgctgctcgtgctgtgcgcggtccagctgctcctgatgcgcacctcctgggccctgtgcgaggccctcaccctggccaccggccccatcacgaccctgtgggagggcagcccggggaagttctggaacaccaccatcgcggtgtccatggccaacatcttccggggcagctacctcgccggggccggcctggccttctccatcatgaagtccgtggggacgggcaagcgcggcaccgggagccagggcgagaccctgggggagaagtggaagaagaagctcaaccagctgtcccggaaggagttcgacctgtacaagaagtccggcatcaccgaggtcgaccgcaccgaggcgaaggaggggctcaagcggggcgagatcacgcaccacgccgtgtcccgcggcagcgccaagctgcagtggttcgtggagcggaacatggtcatccccgaggggcgcgtgatcgacctgggctgcgggcggggcgggtggtcctactactgcgccggcctcaagaaggtgaccgaggtccgcggctacaccaagggcgggcccgggcacgaggagcccgtgccgatgagcacctacggctggaacatcgtgaagctgatgtccgggaaggacgtcttctacctgccgcccgagaagtgcgacacgctcctgtgcgacatcggcgagagctcccccagcccgaccgtggaggagtcccggaccatccgcgtgctgaagatggtcgagccctggctgaagaacaaccagttctgcatcaaggtgctcaacccctacatgcccaccgtgatcgagcacctggagcgcctgcagcggaagcacggcgggatgctcgtccgcaacccgctgagccggaactccacgcacgagatgtactggatcagcaacggcaccgggaacatcgtggcctccgtgaacatggtcagccgcctgctcctgaaccggttcaccatgacccaccgccggcccacgatcgagaaggacgtggacctgggcgcgggcacccgccacgtgaacgccgagcccgagaccccgaacatggacgtcatcggggagcggatcaagcgcatcaaggaggagcacaactccacctggcactacgacgacgagaacccctacaagacgtgggcctaccacggcagctacgaggtgaaggccaccgggtccgccagcagcatgatcaacggcgtcgtgaagctcctgaccaagccctgggacgtggtccccatggtgacccagatggcgatgacggacaccaccccgttcgggcagcagcgggtgttcaaggagaaggtcgacacccgcacgccccggtccatgcccggcacccgccgggtgatgggcatcaccgccgagtggctgtggcgcaccctcgggcggaacaagaagccccgcctgtgcacgcgggaggagttcaccaagaaggtgcgcaccaacgccgccatgggcgcggtcttcaccgaggagaaccagtgggacagcgccaaggccgccgtggaggacgaggacttctggaagctggtggaccgcgagcgggagctccacaagctggggaagtgcggctcctgcgtctacaacatgatggggaagcgcgagaagaagctgggcgagttcggcaaggccaaggggagccgggcgatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccggcggggccatgtacgccgacgacacggcggggtgggacacccggatcaccgaggacgacctgcacaacgaggagaagatcacccagcagatggaccccgagcaccgccagctggccaacgccatcttcaagctcacgtaccagaacaaggtggtcaaggtgcagcggcccacccccaccgggaccgtgatggacatcatctcccgcaaggaccagcggggcagcgggcaggtcggcacctacgggctgaacacgttcaccaacatggaggcccagctgatccgccagatggagggcgagggggtgctctccaaggccgacctggagaacccgcacctccccgagaagaagatcacccagtggctcgagaccaagggcgtggagcggctgaagcgcatggcgatcagcggcgacgactgcgtcgtgaagcccatcgacgaccggttcgccaacgccctgctcgccctgaacgacatggggaaggtgcgcaaggacatcccccagtggcagccgtccaagggctggcacgactggcagcaggtccccttctgcagccaccacttccacgagctgatcatgaaggacgggcggaagctcgtggtgccctgccgcccccaggacgagctgatcggccgggcccgcatctcccagggggcgggctggagcctgcgggagacggcctgcctcggcaaggcctacgcccagatgtggtccctgatgtacttccaccgccgcgacctgcggctcgcgagcaacgccatctgctccgccgtcccggtgcactgggtgcccaccagccgcaccacctggagcatccacgcccaccaccagtggatgacgaccgaggacatgctgaccgtctggaaccgggtgtggatcgaggacaacccctggatggaggacaagacccccgtgacgacctgggagaacgtcccgtacctggggaagcgcgaggaccagtggtgcggctccctcatcgggctgaccagccgggccacctgggcgcagaacatccccacggccatccagcaggtccgctccctgatcggcaacgaggagttcctcgactacatgcccagcatgaagcggttccgcaaggaggaggagtccgagggggccatctggtga

SEQ ID NO: 10151 - RNA, 9876 nt, synthetic construct
  misc_feature 1..9876: note = derived and/or modified CDS sequence (opt1) from DENV-3__EU687233__SS-prME
  source 1..9876: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtcgcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgcgatcctgttcgaggaggtgatgcgggggaagttcggcaagaagcacatgatcgccggggtgttcttcaccttcgtcctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtcgcctggcgcacggcgaccctgatcctcgccggggtgagcctgctgccggtctgccagtccagctccatgcggaagtccgactggctccccatgaccgtggccgccatgggcgtgccgcccctcccgctgttcatcttctccctcaaggacaccctgaagcgccgcagctggcccctgaacgagggggtcatggccgtgggcctcgtgtccatcctggcgagctccctgctccggaacgacgtccccatggccggccccctggtggccgggggcctgctcatcgcctgctacgtgatcacggggaccagcgccgacctgaccgtcgagaaggcggccgacgtgacctgggaggaggaggccgagcagacgggcgtgtcccacaacctgatgatcaccgtcgacgacgacgggaccatgcgcatcaaggacgacgagaccgagaacatcctcaccgtgctgctgaagacggccctcctgatcgtgagcggcatcttcccgtactccatccccgccaccctgctcgtctggcacacctggcagaagcagacccggcgcagcggcgtgctgtgggacgtgcccagcccgcccgagacgcagaaggcggagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggccagcgtgaagaaggacctgatctcctacggcgggggctggcgcctcagcgcccagtggcagaagggggaggaggtgcaggtcatcgcggtggagcccggcaagaaccccaagaacttccagaccatgcccggcaccttccagaccacgaccggggagatcggcgccatcgccctggacttcaagcccgggaccagcggctcccccatcatcaaccgggagggcaaggtggtcgggctgtacggcaacggggtggtgaccaagaacggcgggtacgtcagcggcatcgcccagacgaacgccgagccggacggccccacccccgagctggaggaggagatgttcaagaagcgcaacctcaccatcatggacctgcaccccgggtccggcaagacccggaagtacctgccggcgatcgtgcgcgaggccatcaagcggcgcctccggacgctgatcctggcccccacccgcgtggtcgccgccgagatggaggaggcgctcaaggggctgcccatccggtaccagaccaccgccaccaagagcgagcacaccggccgcgagatcgtggacctgatgtgccacgccaccttcaccatgcggctcctgtcccccgtgcgcgtcccgaactacaacctgatcatcatggacgaggcccacttcacggaccccgccagcatcgcggcccgggggtacatctccacccgcgtgggcatgggcgaggccgccgcgatcttcatgaccgccacgccgcccgggacggccgacgccttcccgcagagcaacgcccccatccaggacgaggagcgcgacatccccgagcggtcctggaacagcggcaacgagtggatcaccgacttcgcggggaagaccgtgtggttcgtcccctccatcaaggccggcaacgacatcgccaactgcctccgcaagaacgggaagaaggtgatccagctgagccggaagaccttcgacacggagtaccagaagaccaagctgaacgactgggacttcgtggtcaccaccgacatctccgagatgggcgccaacttcaaggccgaccgcgtgatcgacccgcggcgctgcctcaagcccgtgatcctgacggacggccccgagcgggtcatcctggcggggcccatgccggtgaccgccgccagcgccgcccagcgccggggccgcgtggggcggaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagagccgcaagacgttcgtcgagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctacagcgacccgctggccctcaaggagttcaaggacttcgcggccggccggaagtccatcgccctggacctggtgacggagatcgggcgcgtccccagccacctcgcccaccggacccgcaacgccctggacaacctggtgatgctccacaccagcgagcacggcgggaaggcgtaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtcatcgcctccagcggcatgctctggatggccgagatcccgctgcagtggatcgcgtccgccatcgtgctggagttcttcatgatggtgctcctgatccccgagcccgagaagcagcgcacgccccaggacaaccagctggcctacgtcgtgatcgggatcctcacgctggccgccatcatcgcggccaacgagatgggcctgctcgagaccaccaagcgggacctgggcatgagcaaggagccgggggtggtctcccccaccagctacctggacgtggacctccaccccgcctccgcctggacgctgtacgcggtggccaccaccgtcatcacccccatgctgcgccacacgatcgagaacagcaccgccaacgtgtccctcgccgccatcgcgaaccaggccgtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgcgatcatcggccccggcctccaggccaaggccacccgggaggcccagaagcgcaccgccgcggggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcggacctcctgggccctctgcgaggccctgaccctggcgaccggccccatcacgaccctctgggagggcagccccgggaagttctggaacaccaccatcgccgtctccatggccaacatcttccgcggcagctacctggccggggccggcctggcgttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtcgcgtccgtgaacatggtgagccggctcctgctgaaccgcttcaccatgacccaccggcgcccgacgatcgagaaggacgtcgacctcggcgccggcacccggcacgtgaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggccaccgggtccgcgagcagcatgatcaacggcgtggtcaagctgctgaccaagccctgggacgtggtgcccatggtcacccagatggccatgacggacaccacccccttcgggcagcagcgcgtgttcaaggagaaggtggacacccggacgccgcgctccatgcccggcacccggcgcgtcatgggcatcaccgccgagtggctctggcggaccctggggcgcaacaagaagccccggctgtgcacgcgcgaggagttcaccaagaaggtgcgcaccaacgccgcgatgggcgccgtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtggtgaaggtccagcgccccacccccaccggcaccgtgatggacatcatctcccggaaggaccagcgcggcagcggccaggtgggcacctacgggctgaacacgtgccactccaacatggaggcccagctcatccggcagatggagggcgagggggtcctgagcaaggcggacctggagaacccccacctctccgagaagaagatcacccagtggctggagaccaagggcgtggagcgcctgaagcggatggccatcagcggcgacgactgcgtggtcaagccgatcgacgaccgcttcgccaacgccctcctggccctgaacgacatggggaaggtgcggaaggacatcccccagtggcagccctccaagggctggcacgactggcagcaggtccccttctgcagccaccacttccacgagctcatcatgaaggacgggcgcaagctggtcgtgccgtgccggccccaggacgagctgatcggccgcgcgcggatctcccagggggccggctggagcctccgcgagaccgcctgcctgggcaaggcctacgcgcagatgtggtccctgatgtacttccaccgccgggacctccgcctggccagcaacgccatctgcagcgccgtgcccgtccactgggtgcccacgtcccggaccacctggagcatccacgcccaccaccagtggatgaccacggaggacatgctgaccgtgtggaaccgcgtctggatcgaggacaacccgtggatggaggacaagacccccgtgaccacgtgggagaacgtgccctacctcgggaagcgggaggaccagtggtgcggctccctgatcgggctgaccagccgcgcgacctgggcccagaacatccccaccgccatccagcaggtccggtccctcatcggcaacgaggagttcctggactacatgccgagcatgaagcgcttccggaaggaggaggagtccgagggggccatctggtga

SEQ ID NO: 10152 - RNA, 9873 nt, synthetic construct
  misc_feature 1..9873: note = derived and/or modified CDS sequence (opt1) from DENV-3__EU687234__SS-prME
  source 1..9873: mol_type = other RNA
accagcctgtgcctcatgatgatcctgcccgcggcgctggcgttccacctcaccagccgggacggggagccgcggatgatcgtggggaagaacgagcggggcaagagcctgctgttcaagacggccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaaggtgcccttcagcaccgaggacgggcagggcaaggcgcacagcggccgcctgatcacggccaaccccgtggtcaccaagaaggaggagcccgtgaacatcgaggccgagccgcccttcggggagtccaacatcgtgatcggcatcggggacaacgccctgaagatcaactggtacaagaagggcagctccatcgggaagatgttcgaggcgaccgcccggggcgcccgccggatggccatcctgggcgacaccgcctgggacttcgggagcgtcggcggggtgctcaactccctgggcaagatggtgcaccagatcttcgggagcgcgtacacggccctgttctccggcgtcagctgggtgatgaagatcggcatcggggtgctcctgacctggatcggcctgaactccaagaacaccagcatgtccttcagctgcatcgtcatcgggatcatcaccctctacctgggcgccgtggtgcaggccgacatggggtgcgtcatcaactggaagggcaaggagctgaagtgcggctccgggatcttcgtgacgaacgaggtgcacacctggaccgagcagtacaagttccaggccgacagccccaagcgcctcgcgaccgccatcgccggcgcctgggagaacggggtctgcggcatccgctccacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtacagctggaagacctgggggaaggcgaagatcgtgaccgccgagacccagaactccagcttcatcatcgacggccccaacacgcccgagtgcccctccgccagccgggcctggaacgtctgggaggtggaggactacgggttcggcgtgttcaccaccaacatctggctcaagctgcgcgaggtctacacccagctgtgcgaccaccggctcatgagcgcggccgtgaaggacgagcgcgccgtgcacgccgacatgggctactggatcgagtcccagaagaacgggagctggaagctggagaaggcctccctgatcgaggtcaagacctgcacgtggcccaagtcccacaccctctggtccaacggcgtgctggagagcgacatgatcatccccaagtccctggcggggcccatcagccagcacaactaccggccgggctaccacacccagaccgccgggccctggcacctcggcaagctggagctggacttcaactactgcgagggcacgaccgtggtcatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtcagcgccggctccgggaaggtggacaacttcacgatgggcgtgctgtgcctcgccatcctgttcgaggaggtcatgcgggggaagttcggcaagaagcacatgatcgccggggtgttcttcaccttcgtgctgctcctgagcggccagatcacctggcgcgacatggcgcacaccctgatcatgatcggctccaacgccagcgaccggatggggatgggcgtcacgtacctcgccctgatcgccaccttcaagatccagcccttcctggccctcgggttcttcctgcgcaagctgaccagccgggagaacctcctgctgggcgtgggcctcgcgatggccaccacgctgcagctgcccgaggacatcgagcagatggccaacgggatcgccctcggcctgatggcgctgaagctcatcacccagttcgagacctaccagctgtggaccgccctgatctccctcacgtgcagcaacaccatcttcaccctgaccgtcgcctggcgcacggccaccctgatcctcgccggggtgtccctgctgccggtgtgccagagctccagcatgcggaagaccgactggctccccatgaccgtcgcggccatgggcgtgccgcccctcccgctgttcatcttctccctcaaggacacgctgaagcgccgcagctggcccctgaacgagggggtgatggccgtcggcctcgtgtccatcctggccagctccctgctccggaacgacgtgcccatggccggccccctggtcgccggcgggctgctcatcgcctgctacgtgatcaccgggaccagcgccgacctgaccgtggagaaggccgccgacgtcacgtgggaggaggaggcggagcagaccggggtgtcccacaacctgatgatcaccgtggacgacgacgggaccatgcgcatcaaggacgacgagaccgagaacatcctcacggtcctgctgaagaccgccctcctgatcgtgagcggcatcttcccgtactccatccccgccaccctgctcgtgtggcacacctggcagaagcagacgcagcggagcggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcgagcgtcaagaaggacctgatctcctacggcgggggctggcggctcagcgcccagtggcagaagggggaggaggtccaggtgatcgccgtcgagcccggcaagaaccccaagaacttccagaccatgcccggcaccttccagacgaccaccggggagatcggcgccatcgcgctggacttcaagcccgggaccagcggctcccccatcatcaaccgcgagggcaaggtggtggggctgtacggcaacggggtcgtgacgaagaacggcgggtacgtgagcggcatcgcccagaccaacgccgagccggacggccccacccccgagctggaggaggagatgttcaagaagcggaacctcaccatcatggacctgcaccccgggtccggcaagacgcgcaagtacctgccggccatcgtccgggaggccatcaagcgccggctccgcaccctgatcctggcgcccacccgggtggtggccgccgagatggaggaggccctcaaggggctgcccatccgctaccagaccacggccaccaagagcgagcacaccggccgggagatcgtcgacctgatgtgccacgcgaccttcacgatgcgcctcctgtcccccgtgcgggtgccgaactacaacctgatcatcatggacgaggcccacttcaccgaccccgccagcatcgccgcccgcgggtacatctccacccgggtcggcatgggcgaggcggccgccatcttcatgaccgccacgccgcccgggaccgcggacgccttcccgcagagcaacgcccccatccaggacgaggagcgcgacatccccgagcgctcctggaacagcggcaacgagtggatcaccgacttcgccgggaagaccgtgtggttcgtgccctccatcaaggccggcaacgacatcgcgaactgcctccggaagaacgggaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacggccccgagcgcgtgatcctggccgggcccatgccggtcaccgccgcgagcgccgcccagcggcgcggccgggtggggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcccacaaggtggcgtccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtacagcgacccgctggccctcaaggagttcaaggacttcgccgccggccgcaagtccatcgcgctggacctggtgaccgagatcgggcgggtgcccagccacctcgcccaccgcacccggaacgccctggacaacctggtcatgctccacaccagcgagcacggcgggcgcgcctaccggcacgccgtggaggagctgcccgagacgatggagaccctgctcctgctgggcctcatgatcctgctgaccgggggcgcgatgctgttcctgatctccggcaaggggatcggcaagaccagcatcgggctgatctgcgtgatcgcctccagcggcatgctctggatggccgagatcccgctgcagtggatcgcctccgccatcgtcctggagttcttcatgatggtgctcctgatccccgagcccgagaagcagcgcacgccccaggacaaccagctggcgtacgtggtcatcgggatcctcaccctggccgccatcatcgccgccaacgagatgggcctgctcgagaccaccaagcgggacctgggcatgagcaaggagccgggggtggtgtcccccacgagctacctggacgtcgacctccaccccgcgtccgcctggaccctgtacgccgtggccaccaccgtgatcacgcccatgctgcgccacaccatcgagaacagcaccgcgaacgtctccctcgccgccatcgccaaccaggccgtggtgctgatgggcctggacaaggggtggccgatcagcaagatggacctcggcgtccccctgctggcgctcgggtgctactcccaggtgaaccccctgaccctgacggccgccgtgctcctgctgatcacccactacgccatcatcggccccggcctccaggccaaggcgacccgggaggcccagaagcgcaccgccgccgggatcatgaagaacccgacggtcgacggcatcatgaccatcgacctggaccccgtgatctacgacagcaagttcgagaagcagctgggccaggtgatgctcctggtcctgtgcgccgtgcagctcctgctgatgcggacctcctgggcgctctgcgaggccctgaccctggccacgggccccatcaccaccctctgggagggcagccccgggaagttctggaacaccacgatcgccgtgtccatggcgaacatcttccgcggcagctacctggccggggccggcctggccttctccatcatgaagtccgtcgggaccggcaagcggggcaccgggagccagggcgagaccctcggggagaagtggaagaagaagctgaaccagctgtcccgcaaggagttcgacctctacaagaagtccggcatcaccgaggtggaccggacggaggccaaggaggggctgaagcgcggcgagatcacccaccacgcggtgtcccggggcagcgccaagctgcagtggttcgtcgagcgcaacatggtgatcccggaggggcgggtgatcgacctcggctgcgggcgcggcgggtggtcctactactgcgccggcctgaagaaggtcaccgaggtgcggggctacaccaagggcgggcccgggcacgaggagcccgtgcccatgagcacgtacggctggaacatcgtcaagctgatgtccgggaaggacgtgttctacctcccgcccgagaagtgcgacaccctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccacggtcatcgagcacctggagcggctccagcgcaagcacggcgggatgctggtgcggaaccccctgagccgcaactccacccacgagatgtactggatcagcaacggcaccgggaacatcgtggcctccgtcaacatggtgagccggctcctgctgaaccgcttcaccatgacgcaccggcgcccgaccatcgagaaggacgtggacctcggcgccggcacccggcacgtcaacgcggagcccgagacccccaacatggacgtgatcggggagcgcatcaagcggatcaaggaggagcacaactccacgtggcactacgacgacgagaacccgtacaagacctgggcctaccacggcagctacgaggtcaaggccaccgggtccgccagcagcatgatcaacggcgtggtgaagctgctgaccaagccctgggacgtcgtgcccatggtgacgcagatggccatgaccgacaccacccccttcgggcagcagcgcgtcttcaaggagaaggtggacacgcggaccccgcgctccatgcccggcacccggcgcgtgatgggcatcaccgcggagtggctctggcggacgctggggcgcaacaagaagccccggctgtgcacccgcgaggagttcaccaagaaggtccgcaccaacgccgccatgggcgccgtgttcacggaggagaaccagtgggacagcgcgaaggccgccgtggaggacgaggacttctggatcctcgtcgaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcgcggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacaccgccgggtgggacacccgcatcaccgaggacgacctgcacaacgaggagaagatcacgcagcagatggacccggagcaccggcagctcgcgtccgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtcgagcgcctgaagcggatggccatctccggcgacgactgcgtggtgaagcccatcgacgaccgcttcgcgaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggccggctggtccctccgcgagaccgcgtgcctgggcaaggcctacgcccagatgtggagcctgatgtacttccaccgccgggacctccgcctggcctccaacgcgatctgcagcgccgtgcccgtgcactgggtcccgaccagccggaccacgtggtccatccacgcccaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgacctcccgcgccacgtgggcccagaacatcccgaccgcgatccagcaggtccggagcctcatcggcaacgaggagttcctggactacatgccctccatgaagcgcttccggaaggaggaggagagcgagggggccatctggtga

SEQ ID NO: 10153 - RNA, 9873 nt, synthetic construct
  misc_feature 1..9873: note = derived and/or modified CDS sequence (opt1) from DENV-3__EU687196__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgatcttcaccttcgtcctgctcctgtccggccagatcacctggcgcgacgtggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtcggcctcgccatggccacgaccctgcagctgcccgaggacatcgagcagatggccaacgggatcgcgctcggcctgatggccctgaagctcaccacccagttcgagacgtaccagctgtggaccgccctgatcagcctgacctgctccaacaccatcttcacgctgaccgtggcctggcgcaccgccaccctgatcctcgcgggggtcagcctgctgccggtgtgccagtccagctccatgcggaagacggactggctccccatgaccgtggccgccatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacgtccgccgacctgaccgtggagaaggccgcggacgtgacctgggaggaggaggccgagcagaccggcgtcagccacaacctgatgatcaccgtggacgacgacgggacgatgcgcatcaaggacgacgagaccgagaacatcctcaccgtgctgctgaagaccgccctcctgatcgtctccggcatcttcccgtacagcatccccgccacgctgctcgtgtggcacacctggcagaagcagacccagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagacgatgcccggcatcttccagaccaccaccggggagatcggcgcgatcgccctggacttcaagcccgggacgagcggcagccccatcatcaaccgcgagggcaaggtcgtggggctgtacggcaacggggtggtcaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtcgtggccgccgagatggaggaggccctcaaggggctgcccatccgctaccagacgaccgcgaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtctggttcgtgcccagcatcaaggcgggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacatgagcgagcacggcgggaaggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccgtgcgcgtcctgaagatggtggagccgtggctcaagaacaaccagttctgcatcaaggtgctgaacccctacatgcccacggtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcaccatgacgcaccgccggccgaccatcgagaaggacgtggacctcggcgcgggcacccgccacgtcaacgccgagcccgagacccccaacatggacgtgatcggggagcggatcaagcgcatcaaggaggagcacatcagcacgtggcactacgacgacgagaacccgtacaagacctgggcctaccacggctcctacgaggtcaaggccaccgggagcgcctccagcatgatcaacggcgtggtgaagctgctgaccaagccctgggacgtcgtgcccatggtgacgcagatggcgatgaccgacaccacccccttcgggcagcagcgggtcttcaaggagaaggtggacacgcgcaccccgcggagcatgcccggcacccgccgggtgatgggcatcaccgccgagtggctctggcgcacgctggggcggaacaagaagccccgcctgtgcacccgggaggagttcaccaagaaggtccgcaccaacgccgccatgggcgcggtgttcacggaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccttccgggagaccgcctgcctcggcaaggcctacgcccagatgtggagcctgatgtacttccaccgccgcgacctgcggctcgcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctggggaagcgcgaggaccagtggtgcggcagcctcatcgggctgacctcccgggccacgtgggcgcagaacatcccgaccgccatccagcaggtccgcagcctgatcggcaacgaggagttcctcgactacatgccctccatgaagcggttccgcaaggaggaggagagcgagggggccatctggtga

SEQ ID NO: 10154 - RNA, 9873 nt, synthetic construct
  misc_feature 1..9873: note = derived and/or modified CDS sequence (opt1) from DENV-3__EU854298__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccaacgccagccgggcgtggaacgtgtgggaggtggaggactacgggttcggcgtcttcaccaccaacatctggctcaagctgcgcgaggtgcacacccagctgtgcgaccaccggctcatgtccgccgccgtgaaggacgagcgcgccgtccacgccgacatgggctactggatcgagagccagaagaacgggagctggaagctggagaaggcgtccctgatcgaggtgaagacctgcacgtggcccaagtcccacaccctctggtccaacggcgtgctggagagcgacatgatcatccccaagtccctggccgggcccatcagccagcacaactaccggccgggctaccacacccagaccgccgggccctggcacctcggcaagctggagctggacttcaactactgcgagggcacgaccgtcgtgatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccgggaaggtggacaacttcacgatgggcgtcctgtgcctcgccatcctgttcgaggaggtgatgcgggggaagttcggcaagaagcacatgatcgcgggggtgttcttcaccttcgtcctgctcctgagcggccagatcacctggcgcgacatggcccacaccctgatcatgatcggctccaacgccagcgaccggatggggatgggcgtgacgtacctcgccctgatcgccaccttcaagatccagcccttcctggcgctcgggttcttcctgcgcaagctgacctcccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgcagcaacaccatcttcaccctgaccgtcgcctggcgcacggccaccctgatcctcgcgggggtgtccctgctgccggtctgccagagctccagcatgcggaagaccgactggctccccatgaccgtggccgccatgggcgtgccgcccctcccgctgttcatcttctccctcaaggacacgctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggaccagcgccgacctgaccgtcgagaaggccgcggacgtgacgtgggaggaggaggccgagcagaccggcgtgtcccacaacctgatgatcaccgtcgacgacgacgggaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcgcctacaacgggaagcgcctggagcccaactgggccagcgtgaagaaggacctgatctcctacggcgggggctggcggctcagcgcccagtggcagaagggggaggaggtgcaggtcatcgcggtggagcccggcaagaaccccaagaacttccagaccatccccggcaccttccagaccacgaccggggagatcggcgccatcgccctggacttcaagcccgggacctccggcagccccatcatcaaccgcgagggcaaggtggtcgggctgtacggcaacggggtggtgaccaagaacggcgggtacgtcagcggcatcgcccagacgaacgccgagccggacggccccacccccgagctggaggaggagatgttcaagaagcggaacctcaccatcatggacctgcaccccgggtccggcaagacccgcaagtacctgccggcgatcgtgcgggaggccatcaagcgccggctccgcacgctgatcctggcccccacccgggtggtcgccgccgagatggaggaggcgctcaaggggctgcccatccgctaccagaccaccgccaccaagagcgagcacaccggccgggagatcgtggacctgatgtgccacgccaccttcaccatgcgcctcctgtcccccgtgcgggtcccgaactacaacctgatcatcatggacgaggcccacttcacggaccccgccagcatcgcggcccgcgggtacatctccacccgggtgggcatgggcgaggccgccgcgatcttcatgaccgccacgccgcccgggacggccgacgccttcccgcagagcaacgcccccatccaggacgaggagcgcgacatccccgagcgctcctggaacagcggcaacgagtggatcaccgacttcgcggggaagaccgtgtggttcgtcccctccatcaaggccggcaacgacatcgccaactgcctccggaagaacgggaagaaggtgatccagctgagccgcaagaccttcgacacggagtaccagaagaccaagctgaacgactgggacttcgtggtcaccaccgacatctccgagatgggcgccaacttcaaggccgaccgggtgatcgacccgcgccggtgcctcaagcccgtgatcctgacggacggccccgagcgcgtcatcctggcggggcccatgccggtgaccgccgccagcgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagagccggaagacgttcgtcgagctgatgcgccgcggggacctccccgtgtggctggcccacaaggtcgcctccgagggcatcaagtacaccgaccgcaagtggtgcttcgacgggcagcggaacaaccagatcctggaggagaacatggacgtggagatctggaccaaggagggcgagcgcaagaagctccggccccgctggctggacgcccgcacctacagcgacccgctggccctcaaggagttcaaggacttcgcggccggccggaagtccatcgccctggacctggtgacggagatcgggcgcgtccccagccacctcgcccaccggacccgcaacgccctggacaacctggtgatgctccacacctccgagcacggcgggaaggcgtaccggcacgccgtggaggagctgcccgagaccatggagacgctgctcctgctgggcctcatgatcctgctgaccgggggcgccatgctgttcctgatcagcggcaaggggatcggcaagaccagcatcgggctgatctgcgtcatcgcctccagcggcatgctctggatggccgagatcccgctgcagtggatcgcgtccgccatcgtgctggagttcttcatgatggtgctcctgatccccgagcccgagaagcagcgcacgccccaggacaaccagctggcctacgtcgtgatcgggatcctcacgctggccgccatcatcgcggccaacgagatgggcctgctcgagaccaccaagcgggacctgggcatgagcaaggagccgggggtggtctcccccaccagctacctggacgtggacctccaccccgcctccgcctggacgctgtacgcggtggccaccaccgtcatcacccccatgctgcgccacacgatcgagaacagcaccgccaacgtgtccctcgccgccatcgcgaaccaggccgtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgcgatcatcggccccggcctccaggccaaggccacccgggaggcccagaagcgcaccgccgcggggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcggacctcctgggccctctgcgaggccctgaccctggcgaccggccccatcacgaccctctgggagggcagccccgggaagttctggaacaccaccatcgccgtctccatggccaacatcttccgcggcagctacctggccggggccggcctggcgttctccatcatgaagtccgtggggacgggcaagcggggcaccgggtcccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtcgcgtccgtgaacatggtgagccggctcctgctgaaccgcttcaccatgacccaccggcgcccgacgatcgagaaggacgtcgacctcggcgccggcacccggcacgtgaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggccaccgggtccgcgagctccatgatcaacggcgtggtcaagctgctgaccaagccctgggacgtggtgcccatggtcacccagatggccatgacggacaccacccccttcgggcagcagcgcgtgttcaaggagaaggtggacacccggacgccgcgcagcatgcccggcacccggcgcgtcatgggcatcaccgccgagtggctctggcggaccctggggcgcaacaagaagccccggctgtgcacgcgcgaggagttcaccaagaaggtgcgcaccaacgccgcgatgggcgccgtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtggtgaaggtccagcgccccacccccaccggcaccgtgatggacatcatctcccggaaggaccagcgcggcagcggccaggtgggcacctacgggctgaacacgttcaccaacatggaggtccagctcatccggcagatggagggcgagggggtgctgtccaaggccgacctggagaacccccacctcccggagaagaagatcacccagtggctggagaccaagggcgtggagcgcctgaagcggatggcgatcagcggcgacgactgcgtcgtgaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtggtgccctgccggccccaggacgagctgatcggccgcgcccggatctcccagggggcgggctggagcctccgcgagacggcctgcctgggcaaggcctacgcccagatgtggtccctgatgtacttccaccgccgggacctccgcctggcgagcaacgccatctgctccgccgtccccgtgcactgggtgccgaccagccggaccacctggtccatccacgcccaccaccagtggatgacgaccgaggacatgctgaccgtctggaaccgcgtgtggatcgaggacaacccctggatggaggacaagacccccgtgacgacctgggagaacgtcccctacctcgggaagcgggaggaccagtggtgcggcagcctgatcgggctgaccagccgcgccacctgggcgcagaacatcccgacggccatccaccaggtgcggtccctcatcggcaacgaggagttcctggactacatgcccagcatgaagcgcttccggaaggaggaggagctggagggggccatctggtga

SEQ ID NO: 10155 - RNA, 9873 nt, synthetic construct
  misc_feature 1..9873: note = derived and/or modified CDS sequence (opt1) from DENV-3__FJ373306__SS-prME
  source 1..9873: mol_type = other RNA
accagcctctgcctcatgatgatcctgcccgcggcgctggcgttccacctcaccagccgggacggcgagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacgtgggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaaggtgcccttcagcaccgaggacgggcagggcaaggcgcacaacggccgcctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgtgatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggcgaagatcgtcaccgccgagacccagaacagctccttcatcatcgacggccccaacacgcccgagtgccccagcgcctcccgggcctggaacgtgtgggaggtggaggactacgggttcggcgtcttcagcaccaacatctggctcaagctgcgcgaggtgtacacccagctgtgcgaccaccggctcatgagcgcggccgtgaaggacgagcgcgccgtccacgccgacatgggctactggatcgagtcccagaagaacgggagctggaagctggagaaggcctccctgatcgaggtgaagacctgcacctggcccaagtcccacacgctctggtccaacggcgtgctggagagcgacatgatcatccccaagtccctggcggggcccatcagccagcacaactaccggccgggctaccacacccagaccgccgggccctggcacctcggcaagctggagctggacttcaactactgcgagggcaccacggtcgtgatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgttcttcacgttcgtcctgctcctgagcggccagatcacctggcgcgacatggcgcacaccctgatcatgatcggctccaacgccagcgaccggatggggatgggcgtgacctacctcgccctgatcgccacgttcaagatccagcccttcctggccctcgggttcttcctgcgcaagctgaccagccgggagaacctcctgctgggcgtcggcctcgcgatggccaccaccctgcagctgcccgaggacatcgagcagatggccaacgggatcgccctcggcctgatggcgctgaagctcatcacgcagttcgagacctaccagctgtggaccgccctgatctccctgacctgcagcaacacgatcttcaccctgaccgtggcctggcgcaccgccacgctgatcctcgccggggtgtccctgctgccggtctgccagagctccagcatgcggaagaccgactggctccccatgaccgtggcggccatgggcgtgccgcccctcccgctgttcatcttctccctcaaggacaccctgaagcgccgcagctggcccctgaacgagggggtcatggccgtgggcctcgtgtccatcctggccagctccctgctccggaacgacgtccccatggccggccccctggtggccggcgggctgctcatcgcctgctacgtgatcacggggaccagcgccgacctgaccgtcgagaaggccgccgacgtgacctgggaggaggaggcggagcagacgggggtgtcccacaacctgatgatcaccgtcgacgacgacgggaccatgcgcatcaaggacgacgagaccgagaacatcctcaccgtgctgctgaagacggccctcctgatcgtgagcggcatcttcccgtactccatccccgccaccctgctcgtctggcacacctggcagaagcagacccagcggagcggcgtgctgtgggacgtgcccagcccgcccgagacgcagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggcgagcgtgaagaaggacctgatctcctacggcgggggctggcggctcagcgcccagtggcagaagggggaggaggtgcaggtcatcgccgtggagcccggcaagaaccccaagaacttccagaccatgcccggcaccttccagaccacgaccggggagatcggcgccatcgcgctggacttcaagcccgggaccagcggctcccccatcatcaaccgcgagggcaaggtggtcgggctgtacggcaacggggtggtgaccaagaacggcgggtacgtcagcggcatcgcccagacgaacgccgagccggacggccccacccccgagctggaggaggagatgttcaagaagcggaacctcaccatcatggacctgcaccccgggtccggcaagacccgcaagtacctgccggccatcgtgcgggaggccatcaagcgccggctccgcacgctgatcctggcgcccacccgggtggtcgccgccgagatggaggaggccctcaaggggctgcccatccgctaccagaccaccgccaccaagagcgagcacaccggccgggagatcgtggacctgatgtgccacgcgaccttcaccatgcgcctcctgtcccccgtgcgggtcccgaactacaacctgatcatcatggacgaggcccacttcacggaccccgccagcatcgccgcccgcgggtacatctccacccgggtgggcatgggcgaggcggccgccatcttcatgaccgccacgccgcccgggacggcggacgccttcccgcagagcaacgcccccatccaggacgaggagcgcgacatccccgagcgctcctggaacagcggcaacgagtggatcaccgacttcgccgggaagaccgtgtggttcgtcccctccatcaaggccggcaacgacatcgcgaactgcctccggaagaacgggaagaaggtgatccagctgagccgcaagaccttcgacacggagtaccagaagaccaagctgaacgactgggacttcgtggtcaccaccgacatctccgagatgggcgccaacttcaaggccgaccgggtgatcgacccgcgccggtgcctcaagcccgtgatcctgacggacggccccgagcgcgtcatcctggccgggcccatgccggtgaccgccgcgagcgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgaagggcgagagccggaagacgttcgtggagctgatgcgccgcggggacctccccgtgtggctggcccacaaggtcgcgtccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggccctcaaggagttcaaggacttcgccgccggccgcaagtccatcgcgctggacctggtgacggagatcgggcgggtccccagccacctcgcccaccgcacccggaacgccctggacaacctggtgatgctccacaccagcgagcacggcgggaaggcctaccgccacgccgtggaggagctgcccgagaccatggagacgctgctcctgctgggcctcatgatcctgctgaccgggggcgcgatgctgttcctgatctccggcaaggggatcggcaagaccagcatcgggctgatctgcgtcatcgcctccagcggcatgctctggatggccgagatcccgctgcagtggatcgcctccgccatcgtgctggagttcttcatgatggtgctcctgatccccgagcccgagaagcagcggacgccccaggacaaccagctggcgtacgtcgtgatcgggatcctcacgctggccgccatcatcgccgccaacgagatgggcctgctcgagaccaccaagcgcgacctgggcatgagcaaggagccgggggtggtctcccccaccagctacctggacgtggacctccaccccgcgtccgcctggacgctgtacgccgtggccaccaccgtcatcacccccatgctgcggcacacgatcgagaacagcaccgcgaacgtgtccctcgccgccatcgccaaccaggccgtggtcctgatgggcctggacaaggggtggccgatcagcaagatggacctcggcgtgcccctgctggcgctcgggtgctactcccaggtgaaccccctgaccctgaccgccgccgtcctcctgctgatcacgcactacgccatcatcggccccggcctccaggccaaggcgacccgcgaggcccagaagcggaccgccgccgggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcgcacctcctgggcgctctgcgaggccctgaccctggccaccggccccatcacgaccctctgggagggcagccccgggaagttctggaacaccaccatcgccgtctccatggcgaacatcttccggggcagctacctggccggggccggcctggccttctccatcatgaagtccgtggggacgggcaagcgcggcaccgggagccagggcgagaccctcggggagaagtggaagaagaagctgaaccagctgtcccggaaggagttcgacctctacaagaagtccggcatcaccgaggtggaccgcaccgaggccaaggaggggctgaagcggggcgagatcacgcaccacgcggtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacgcacgagatgtactggatcagcaacggcaccgggaacatcgtcgcctccgtgaacatggtgagccgcctcctgctgaaccggttcaccatgacccaccgccggccgacgatcgagaaggacgtcgacctcggcgccggcacccgccacgtgaacgcggagcccgagacccccaacatggacgtcatcggggagcggatcaagcgcatcaaggaggagcacaactccacctggcactacgacgacgagaacccgtacaagacgtgggcctaccacggcagctacgaggtgaaggccaccgggtccgccagcagcatgatcaacggcgtggtcaagctgctgaccaagccctgggacgtggtgcccatggtcacccagatggccatgacggacaccacccccttcgggcagcagcgggtgttcaaggagaaggtggacacccgcacgccgcggtccatgcccggcacccgccgggtcatgggcatcaccgcggagtggctctggcgcaccctggggcggaacaagaagccccgcctgtgcacgcgggaggagttcaccaagaaggtgcgcaccaacgccgccatgggcgccgtgttcaccgaggagaaccagtgggacagcgcgaaggccgccgtcgaggacgaggacttctggatcctcgtggaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacacggccgggtgggacacccggatcaccgaggacgacctgcacaacgaggagaagatcacccagcagatggacccggagcaccgccagctcgcgaacgccatcttcaagctgacgtaccagaacaaggtggtgaaggtccagcggcccacccccaccggcaccgtgatggacatcatctcccgcaaggaccagcggggcagcggccaggtgggcacctacgggctgaacacgttcaccaacatggaggcccagctcatccgccagatggagggcgagggggtcctgtccaaggccgacctggagaacccccacctcccggagaagaagatcacccagtggctggagaccaagggcgtggagcggctgaagcgcatggccatcagcggcgacgactgcgtggtcaagcccatcgacgaccggttcgcgaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggccggctggagcctccgggagacggcgtgcctgggcaaggcctacgcccagatgtggtccctgatgtacttccaccgccgcgacctccggctggccagcaacgcgatctgctccgccgtgcccgtccactgggtgccgaccagccgcaccacctggagcatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggctccctgatcgggctgaccagccgggccacctgggcccagaacatcccgacggcgatccagcaggtccgctccctcatcggcaacgaggagttcctggactacatgcccagcatgaagcggttccgcaaggaggaggagtccgagggggccatctggtga

SEQ ID NO: 10156 - RNA, 9873 nt, synthetic construct
  misc_feature 1..9873: note = derived and/or modified CDS sequence (opt1) from DENV-3__EU687197__SS-prME
  source 1..9873: mol_type = other RNA
accagcctgtgcctcatgatgatcctgcccgccgccctggcgttccacctcaccagccgcgacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtggtgaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccaacgccagccgggcgtggaacgtgtgggaggtcgaggactacgggttcggcgtgttcaccaccaacatctggctcaagctgcgcgaggtgtacacccagctgtgcgaccaccggctcatgtccgccgccgtcaaggacgagcgcgccgtgcacgccgacatgggctactggatcgagagccagaagaacgggagctggaagctggagaaggcgtccctgatcgaggtgaagacctgcacgtggcccaagtcccacaccctctggtccaacggcgtcctggagagcgacatgatcatccccaagtccctggccgggcccatcagccagcacaactaccggccgggctaccacacccagaccgccgggccctggcacctcggcaagctggagctggacttcaactactgcgagggcacgaccgtggtgatcaccgagaactgcgggacccgcggcccctccctccggacgaccaccgtcagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtgagcgccggctccgggaaggtcgacaacttcacgatgggcgtgctgtgcctcgccatcctgttcgaggaggtgatgcgggggaagttcggcaagaagcacatgatcgcgggggtcttcttcaccttcgtgctgctcctgagcggccagatcacctggcgcgacatggcccacaccctgatcatgatcggctccaacgccagcgaccggatggggatgggcgtgacgtacctcgccctgatcgccaccttcaagatccagcccttcctggcgctcgggttcttcctgcgcaagctgacctcccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgcagcaacaccatcttcaccctgaccgtggcctggcgcacggccaccctgatcctcgcgggggtctccctgctgccggtgtgccagagctccagcatgcggaagaccgactggctccccatgaccgtggccgccatgggcgtgccgcccctcccgctgttcatcttctccctcaaggacacgctgaagcgccgcagctggcccctgaacgagggggtgatggccgtgggcctcgtctccatcctggccagctccctgctccggaacgacgtgcccatggcgggccccctggtggccgggggcctgctcatcgcctgctacgtcatcaccgggaccagcgccgacctgaccgtggagaaggccgcggacgtgacgtgggaggaggaggccgagcagaccggcgtctcccacaacctgatgatcaccgtggacgacgacgggaccatgcgcatcaaggacgacgagaccgagaacatcctcacggtgctgctgaagaccgccctcctgatcgtcagcggcatcttcccgtactccatccccgccaccctgctcgtgtggcacacctggcagaagcagacgcagcggagcggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcgcctacaacgggaagcgcctggagcccaactgggccagcgtgaagaaggacctgatctcctacggcgggggctggcggctcagcgcccagtggcagaagggggaggaggtccaggtgatcgcggtggagcccggcaagaaccccaagaacttccagaccatgcccggcaccttccagaccacgaccggggagatcggcgccatcgccctggacttcaagcccgggacctccggcagccccatcatcaaccgcgagggcaaggtcgtggggctgtacggcaacggggtggtcaccaagaacggcgggtacgtgagcggcatcgcccagacgaacgccgagccggacggccccacccccgagctggaggaggagatgttcaagaagcggaacctcaccatcatggacctgcaccccgggtccggcaagacccgcaagtacctgccggcgatcgtgcgggaggccatcaagcgccggctccgcacgctgatcctggcccccacccgggtcgtggccgccgagatggaggaggcgctcaaggggctgcccatccgctaccagaccaccgccaccaagagcgagcacaccggccgggagatcgtggacctgatgtgccacgccaccttcaccatgcgcctcctgtcccccgtccgggtgccgaactacaacctgatcatcatggacgaggcccacttcacggaccccgccagcatcgcggcccgcgggtacatctccacccgggtgggcatgggcgaggccgccgcgatcttcatgaccgccacgccgcccgggacggccgacgccttcccgcagagcaacgcccccatccaggacgaggagcgcgacatccccgagcgctcctggaacagcggcaacgagtggatcaccgacttcgcggggcggaccgtctggttcgtgccctccatcaaggccggcaacgacatcgccaactgcctccgcaagaacgggaagaaggtgatccagctgagccggaagaccttcgacacggagtaccagaagaccaagctgaacgactgggacttcgtcgtgaccaccgacatctccgagatgggcgccaacttcaaggccgaccgcgtgatcgacccgcggcgctgcctcaagcccgtcatcctgacggacggccccgagcgggtgatcctggcggggcccatgccggtgaccgccgccagcgccgcccagcgccggggccgcgtcgggcggaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtggagatctggaccaaggagggcgagcggaagaagctccgcccccgctggctggacgcccggacctacagcgacccgctggccctcaaggagttcaaggacttcgcggccggccgcaagtccatcgccctggacctggtcacggagatcgggcgggtgcccagccacctcgcccaccgcacccggaacgccctggacaacctggtgatgctccacacctccgagcacggcgggaaggcgtaccgccacgccgtcgaggagctgcccgagaccatggagacgctgctcctgctgggcctcatgatcctgctgaccgggggcgccatgctgttcctgatcagcggcaaggggatcggcaagaccagcatcgggctgatctgcgtgatcgcctccagcggcatgctctggatggccgagatcccgctgcagtggatcgcgtccgccatcgtgctggagttcttcatgatggtcctcctgatccccgagcccgagaagcagcggacgccccaggacaaccagctggcctacgtggtgatcgggatcctcacgctggccgccatcatcgcggccaacgagatgggcctgctcgagaccaccaagcgcgacctgggcatgagcaaggagccgggggtcgtgtcccccaccagctacctggacgtggacctccaccccgcctccgcctggacgctgtacgcggtcgccaccaccgtgatcacccccatgctgcggcacacgatcgagaacagcaccgccaacgtgtccctcgccgccatcgcgaaccaggccgtcgtgctgatgggcctggacaaggggtggccgatcagcaagatggacctcggcgtgcccctgctggccctcgggtgctactcccaggtcaaccccctgaccctgaccgccgccgtgctcctgctgatcacgcactacgcgatcatcggccccggcctccaggccaaggccacccgcgaggcccagaagcggaccgccgcggggatcatgaagaacccgaccgtggacggcatcatgacgatcgacctggaccccgtcatctacgacagcaagttcgagaagcagctgggccaggtgatgctcctggtgctgtgcgccgtccagctcctgctgatgcgcacctcctgggccctctgcgaggccctgaccctggcgaccggccccatcacgaccctctgggagggcagccccgggaagttctggaacaccaccatcgccgtgtccatggccaacatcttccggggcagctacctggccggggccggcctggcgttctccatcatgaagtccgtggggacgggcaagcgcggcaccgggtcccagggcgagaccctcggggagaagtggaagaagaagctgaaccagctgagccggaaggagttcgacctctacaagaagtccggcatcaccgaggtcgaccgcaccgaggccaaggaggggctgaagcggggcgagatcacgcaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacgcacgagatgtactggatcagcaacggcaccgggaacatcgtggcgtccgtgaacatggtcagccgcctcctgctgaaccggttcaccatgacccaccgccggccgacgatcgagaaggacgtggacctcggcgccggcacccgccacgtgaacgccgagcccgagacccccaacatggacgtcatcggggagcggatcaagcgcatcaaggaggagcacaactccacctggcactacgacgacgagaacccgtacaagacgtgggcctaccacggcagctacgaggtgaaggccaccgggtccgcgagctccatgatcaacggcgtcgtgaagctgctgaccaagccctgggacgtggtccccatggtgacccagatggccatgacggacaccacccccttcgggcagcagcgggtgttcaaggagaaggtcgacacccgcacgccgcggagcatgcccggcacccgccgggtgatgggcatcaccgccgagtggctctggcgcaccctggggcggaacaagaagccccgcctgtgcacgcgcgaggagttcaccaagaaggtgcggaccaacgccgcgatgggcgccgtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacacggccgggtgggacacccggatcaccgaggacgacctgcacaacgaggagaagatcacccagcagatggacccggagcaccgccagctcgccaacgccatcttcaagctgacgtaccagaacaaggtggtcaaggtgcagcggcccacccccaccggcaccgtgatggacatcatctcccgcaaggaccagcggggcagcgggcaggtcggcacctacgggctgaacacgttcaccaacatggaggtgcagctcatccgccagatggagggcgagggggtgctgtccaaggccgacctggagaacccccacctcccggagaagaagatcacccagtggctggagaccaagggcgtcgagcggctgaagcgcatggcgatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcccgcatctcccagggggcgggctggagcctccgcgagacggcctgcctgggcaaggcctacgcccagatgtggtccctgatgtacttccaccggcgcgacctccggctggcgagcaacgccatctgctccgccgtgcccgtgcactgggtcccgaccagccgcaccacctggtccatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgaccagccgggccacctgggcgcagaacatcccgacggccatccaccaggtgcgctccctcatcggcaacgaggagttcctggactacatgcccagcatgaagcggttccgcaaggaggaggagctggagggggccatctggtga

SEQ ID NO: 10157 - RNA, 9873 nt, synthetic construct
  misc_feature 1..9873: note = derived and/or modified CDS sequence (opt1) from DENV-3__EU687198__SS-prME
  source 1..9873: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcggcaggtcgagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcgtgggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacgtggatcggcctgaacagcaagaacacctccatgagcttctcctgcatcgccatcgggatcatcaccctctacctgggcgccgtcgtgcaggcggacaccgggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgcgatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtcggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagtccgactggctccccatgaccgtggccgccatgggcgtgccgcccctcccgctgttcatcttctccctcaaggacaccctgaagcgccgcagctggcccctgaacgagggggtgatggccgtgggcctcgtctccatcctggcgagctccctgctccggaacgacgtgcccatggccggccccctggtggccgggggcctgctcatcgcctgctacgtcatcacggggaccagcgccgacctgaccgtggagaaggcggccgacgtgacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcatcttcccgtactccatccccgccaccctgctcgtgtggcacacctggcagaagcagacccggcgcagcggcgtgctgtgggacgtccccagcccgcccgagacgcagaaggcggagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggccagcgtgaagaaggacctgatctcctacggcgggggctggcgcctcagcgcccagtggcagaagggggaggaggtccaggtgatcgcggtggagcccggcaagaaccccaagaacttccagaccatgcccggcaccttccagaccacgaccggggagatcggcgccatcgccctggacttcaagcccgggaccagcggctcccccatcatcaaccgggagggcaaggtcgtggggctgtacggcaacggggtggtcaccaagaacggcgggtacgtgagcggcatcgcccagacgaacgccgagccggacggccccacccccgagctggaggaggagatgttcaagaagcgcaacctcaccatcatggacctgcaccccgggtccggcaagacccggaagtacctgccggcgatcgtgcgcgaggccatcaagcggcgcctccggacgctgatcctggcccccacccgcgtcgtggccgccgagatggaggaggcgctcaaggggctgcccatccggtaccagaccaccgccaccaagagcgagcacaccggccgcgagatcgtggacctgatgtgccacgccaccttcaccatgcggctcctgtcccccgtccgcgtgccgaactacaacctgatcatcatggacgaggcccacttcacggaccccgccagcatcgcggcccgggggtacatctccacccgcgtgggcatgggcgaggccgccgcgatcttcatgaccgccacgccgcccgggacggccgacgccttcccgcagagcaacgcccccatccaggacgaggagcgcgacatccccgagcggtcctggaacagcggcaacgagtggatcaccgacttcgcggggaagaccgtctggttcgtgccctccatcaaggccggcaacgacatcgccaactgcctccgcaagaacgggaagaaggtgatccagctgagccggaagaccttcgacacggagtaccagaagacccgcctgaacgactgggacttcgtcgtgaccaccgacatctccgagatgggcgccaacttcaaggccgaccgggtgatcgacccgcgccggtgcctcaagcccgtcatcctgacggacggccccgagcgcgtgatcctggcggggcccatgccggtgaccgccgccagcgccgcccagcggcgcggccgggtcgggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagagccggaagacgttcgtggagctgatgcgccgcggggacctccccgtctggctggcccacaaggtggcctccgagggcatcaagtacaccgaccgcaagtggtgcttcgacgggcagcggaacaaccagatcctggaggagaacatggacgtggagatctggaccaaggagggcgagaagaagaagctccgcccccgctggctggacgcccggacctacagcgacccgctggccctcaaggagttcaaggacttcgcggccggccgcaagtccatcgccctggacctggtcacggagatcgggcgggtgcccagccacctcgcccaccgcacccggaacgccctggacaacctggtgatgctccacaccagcgagcacggcgggaaggcgtaccgccacgccgtcgaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcgtccgccatcgtgctggagttcttcatgatggtcctcctgatccccgagcccgagaagcagcggacgccccaggacaaccagctggcctacgtggtgatcgggatcctcacgctggccgccatcatcgcggccaacgagatgggcctgctcgagaccaccaagcgcgacctgggcatgagcaaggagccgggggtcgtgtcccccaccagctacctggacgtggacctccaccccgcctccgcctggacgctgtacgcggtcgccaccaccgtgatcacccccatgctgcggcacacgatcgagaacagcaccgccaacgtgtccctcgccgccatcgcgaaccaggccgtcgtgctgatgggcctggacaaggggtggccgatcagcaagatggacctcggcgtgcccctgctggccctcgggtgctactcccaggtcaaccccctgaccctgaccgccgccgtgctcctgctgatcacgcactacgcgatcatcggccccggcctccaggccaaggccacccgcgaggcccagaagcggaccgccgcggggatcatgaagaacccgaccgtggacggcatcatgacgatcgacctggaccccgtcatctacgacagcaagttcgagaagcagctgggccaggtgatgctcctggtgctgtgcgccgtccagctcctgctgatgcgcacctcctgggccctctgcgaggccctgaccctggcgaccggccccatcacgaccctctgggagggcagccccgggaagttctggaacaccaccatcgccgtgtccatggccaacatcttccggggcagctacctggccggggccggcctggcgttctccatcatgaagtccgtggggacgggcaagcgcggcaccgggagccagggcgagaccctcggggagaagtggaagaagaagctgaaccagctgtcccggaaggagttcgacctctacaagaagtccggcatcaccgaggtcgaccgcaccgaggccaaggaggggctgaagcggggcgagatcacgcaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgggtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacgcacgagatgtactggatcagcaacggcaccgggaacatcgtggcgtccgtgaacatggtcagccgcctcctgctgaaccggttcaccatgacccaccgccggccgacgatcgagaaggacgtggacctcggcgccggcacccgccacgtgaacgccgagcccgagacccccaacatggacgtcatcggggagcggatcaagcgcatcaaggaggagcacaactccacctggcactacgacgacgagaacccgtacaagacgtgggcctaccacggcagctacgaggtgaaggccaccgggtccgcgagcagcatgatcaacggcgtcgtgaagctgctgaccaagccctgggacgtggtccccatggtgacccagatggccatgacggacaccacccccttcgggcagcagcgggtgttcaaggagaaggtcgacacccgcacgccgcggtccatgcccggcacccgccgggtgatgggcatcaccgccgagtggctctggcgcaccctggggcggaacaagaagccccgcctgtgcacgcgcgaggagttcaccaagaaggtgcggaccaacgccgcgatgggcgccgtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacacggccgggtgggacacccggatcaccgaggacgacctgcacaacgaggagaagatcacccagcagatggacccggagcaccgccagctcgccaacgccatcttcaagctgacgtaccagaacaaggtggtcaaggtgcagcggcccacccccaccggcaccgtgatggacatcatctcccgcaaggaccagcggggcagcgggcaggtcggcacctacgggctgaacacgttcaccaacatggaggcccagctcatccgccagatggagggcgagggggtgctgtccaaggcggacctggagaacccccacctcagcgagaagaagatcacccagtggctggagaccaagggcgtggagcggctgaagcgcatggccatctccggcgacgactgcgtcgtgaagccgatcgacgaccggttcgccaacgccctcctggccctgaacgacatggggaaggtgcgcaaggacatcccccagtggcagcccagcaagggctggcacgactggcagcaggtccccttctgctcccaccacttccacgagctcatcatgaaggacgggcggaagctggtggtgccgtgccgcccccaggacgagctgatcggccgggcgcgcatcagccagggggccggctggtccctccgcgagacggcctgcctgggcaaggcctacgcgcagatgtggagcctgatgtacttccaccggcgcgacctccggctggcctccaacgccatctgcagcgccgtccccgtgcactgggtgcccaccagccgcaccacctggtccatccacgcccaccaccagtggatgacgaccgaggacatgctgaccgtctggaaccgggtgtggatcgaggacaacccgtggatggaggacaagacccccgtgacgacctgggagaacgtcccctacctcgggaagcgcgaggaccagtggtgcggcagcctgatcgggctgacctcccgggcgacctgggcccagaacatccccacggccatccagcaggtccgcagcctcatcggcaacgaggagttcctggactacatgccgtccatgaagcggttccgcaaggaggaggagagcgagggggccatctggtga

SEQ ID NO: 10158 - RNA, 9873 nt, synthetic construct
  misc_feature 1..9873: note = derived and/or modified CDS sequence (opt1) from DENV-3__EU726769__SS-prME
  source 1..9873: mol_type = other RNA
accagcctgtgcctcatgatgatcctgcccgcggcgctggcgttccacctcaccagccgggacggcgagccgcggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatggtcgccggggtgttcttcaccttcgtgctgctcctgtccggccagatcacctggcgcgacatggcgcacaccctgatcatggtcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtgagcctgctgccggtctgccagtccagctccatgcggaagaccgactggctccccatgaccgtggcggccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggccggccccctggtggccggcgggctgctcatcgcctgctacgtgatcaccgggacctccgccgacctgaccgtcgagaaggccgccgacgtgacgtgggaggaggaggcggagcagaccggggtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtggtcgccgccgagatggaggaggccctcaaggggctgcccatccgctaccagaccacggccaccaagtccgagcacaccggccgggagatcgtggacctgatgtgccacgcgaccttcacgatgcgcctcctgagccccgtgcgggtcccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtgtggttcgtccccagcatcaaggccggcaacgacatcgcgaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgccgcgtccgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtgtggctggcccacaaggtcgcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgccggccgcaagagcatcgcgctggacctggtgaccgagatcgggcgggtcccctcccacctcgcccaccgcacccggaacgccctggacaacctggtgatgctccacaccagcgagcacggcgggaaggcctaccgccacgccgtggaggagctgcccgagacgatggagaccctgctcctgctgggcctcatgatcctgctgaccgggggcgcgatgctgttcctgatcagcggcaaggggatcggcaagacctccatcgggctgatctgcgtcatcgccagctccggcatgctctggatcgccgagatcccgctgcagtggatcgccagcgccatcgtgctggagttcttcatgatggtgctcctgatccccgagcccgagaagcagcggacgccccaggacaaccagctggcgtacgtcgtgatcgggatcctcaccctggccgccatcatcgccgccaacgagatgggcctgctcgagaccaccaagcgcgacctgggcatgtccaaggagccgggggtggtcagccccacgtcctacctggacgtggacctccaccccgcgagcgcctggaccctgtacgccgtggccaccaccgtcatcacgcccatgctgcggcacaccatcgagaactccaccgcgaacgtgagcctcgccgccatcgccaaccaggccgtggtcctgatgggcctggacaaggggtggccgatctccaagatggacctcggcgtgcccctgctggcgctcgggtgctacagccaggtgaaccccctgaccctgacggccgccgtcctcctgctgatcacccactacgccatcatcggccccggcctccaggccaaggcgacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgccgtgcagctcctgctgatgcgcaccagctgggcgctctgcgaggccctgaccctggccacgggccccatcaccaccctctgggagggctcccccgggaagttctggaacaccacgatcgccgtcagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggccaaggaggggctgaagcggggcgagatcacccaccacgcggtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcggccccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgtaccgccggccgaccatcgagaaggacgtcgacctcggcgccggcacccgccacgtgaacgcggagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtggtcaagctgctgaccaagccctgggacgtggtgcccatggtcacgcagatggccatgaccgacaccacccccttcgggcagcagcgggtgttcaaggagaaggtggacacgcgcaccccgcggagcatgcccggcacccgccgggtcatgggcatcaccgcggagtggctctggcgcacgctggggcggaacaagaagccccgcctgtgcacccgggaggagttcaccaagaaggtgcgcaccaacgccgccatgggcgccgtgttcacggaggagaaccagtgggactccgcgaaggccgccgtcgaggacgaggacttctggatcctcgtggaccgcgagcgggagctgcacaaggtggggaagtgcggcagctgcgtctacaacatgatggggaagcgcgagaagaagctgggcgagttcggcaaggccaaggggtcccgggccatctggtacatgtggctcggcgcgcgctacctggagttcgaggccctggggttcctcaacgaggaccactggttcagccgggagaactcctacagcggcgtggagggggagggcctgcacaagctgggctacatcctccgcgacatctccaagatccccgggggcgccatgtacgccgacgacaccgccgggtgggacacccggatcaccgaggacgacctgcacaacgaggagaagatcacgcagcagatggacccggagcaccgccagctggcgaacgccatcttcaagctcacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctgatccgccagatggagggcgagggggtgctcagcaaggccgacctggagaacccccacctccccgagaagaagatcacccagtggctggagacgaagggcgtggagcggctgaagcgcatggccatctccggcgacgactgcgtcgtgaagcccatcgacgaccggttcgcgaacgccctgctcgccctgaacgacatggggaaggtgcgcaaggacatcccccagtggcagcccagcaagggctggcacgactggcagcaggtcccgttctgctcccaccacttccacgagctgatcatgaaggacgggcggaagctcgtggtgccctgccgcccccaggacgagctgatcggccgggcccgcatcagccagggggccggctggtccctgcgggagaccgcgtgcctcggcaaggcctacgcccagatgtggagcctgatgtacttccaccgccgcgacctgcggctcgcctccaacgcgatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctggggaagcgcgaggaccagtggtgcggcagcctcatcgggctgacctcccgggccacgtgggcccagaacatcccgaccgcgatccagcaggtccgcagcctgatcggcaacgaggagttcctcgactacatgccctccatgaagcggttccgcaaggaggaggagagcgagggggccatctggtga

SEQ ID NO: 10159 - RNA, 9873 nt, synthetic construct
  misc_feature 1..9873: note = derived and/or modified CDS sequence (opt1) from DENV-3__EU687239__SS-prME
  source 1..9873: mol_type = other RNA
accagcctgtgcctcatgatgatcctgcccgccgccctggccttccacctcaccagccgcgacggggagccccggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcggcaggtcgagaaggtggagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcgtgggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacgtggatcggcctgaacagcaagaacacctccatgagcttctcctgcatcgccatcgggatcatcaccctctacctgggcgccgtcgtgcaggcggacaccgggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgcgatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtcggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagtccgactggctccccatgaccgtggccgccatgggcgtgccgcccctcccgctgttcatcttctccctcaaggacaccctgaagcgccgcagctggcccctgaacgagggggtgatggccgtgggcctcgtctccatcctggcgagctccctgctccggaacgacgtgcccatggccggccccctggtggccgggggcctgctcatcgcctgctacgtcatcacggggaccagcgccgacctgaccgtggagaaggcggccgacgtgacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcatcttcccgtactccatccccgccaccctgctcgtgtggcacacctggcagaagcagacccggcgcagcggcgtgctgtgggacgtccccagcccgcccgagacgcagaaggcggagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggccagcgtgaagaaggacctgatctcctacggcgggggctggcgcctcagcgcccagtggcagaagggggaggaggtccaggtgatcgcggtggagcccggcaagaaccccaagaacttccagaccatgcccggcaccttccagaccacgaccggggagatcggcgccgtcgccctggacttcaagcccgggaccagcggctcccccatcatcaaccgggagggcaaggtggtggggctgtacggcaacggggtcgtgaccaagaacggcgggtacgtgagcggcatcgcccagacgaacgccgagccggacggccccacccccgagctggaggaggagatgttcaagaagcgcaacctcaccatcatggacctgcaccccgggtccggcaagacccggaagtacctgccggcgatcgtccgcgaggccatcaagcggcgcctccggacgctgatcctggcccccacccgcgtggtggccgccgagatggaggaggcgctcaaggggctgcccatccggtaccagaccaccgccaccaagagcgagcacaccggccgcgagatcgtcgacctgatgtgccacgccaccttcaccatgcggctcctgtcccccgtgcgcgtgccgaactacaacctgatcatcatggacgaggcccacttcacggaccccgccagcatcgcggcccgggggtacatctccacccgcgtcggcatgggcgaggccgccgcgatcttcatgaccgccacgccgcccgggacggccgacgccttcccgcagagcaacgcccccatccaggacgaggagcgcgacatccccgagcggtcctggaacagcggcaacgagtggatcaccgacttcgcggggaagaccgtgtggttcgtgccctccatcaaggccggcaacgacatcgccaactgcctccgcaagaacgggaagaaggtcatccagctgagccggaagaccttcgacacggagtaccagaagaccaagctgaacgactgggacttcgtggtgaccaccgacatctccgagatgggcgccaacttcaaggccgaccgcgtcatcgacccgcggcgctgcctcaagcccgtgatcctgacggacggccccgagcgggtgatcctggcggggcccatgccggtcaccgccgccagcgccgcccagcgccggggccgcgtggggcggaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagagccgcaagacgttcgtcgagctgatgcggcgcggggacctccccgtgtggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacctacagcgacccgctggccctcaaggagttcaaggacttcgcggccggccggaagtccatcgccctggacctggtgacggagatcgggcgcgtgcccagccacctcgcccaccggacccgcaacgccctggacaacctggtcatgctccacaccagcgagcacggcgggaaggcgtaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcgcacgccccaggacaaccagctggcctacgtggtcatcgggatcctcacgctggccgccatcatcgcggccaacgagatgggcctgctcgagaccaccaagcgggacctgggcatgagcaaggagccgggggtggtgtcccccaccagctacctggacgtcgacctccaccccgcctccgcctggacgctgtacgcggtggccaccaccgtgatcacccccatgctgcgccacacgatcgagaacagcaccgccaacgtctccctcgccgccatcgcgaaccaggccgtggtgctgatgggcctggacaaggggtggccgatcagcaagatggacctcggcgtccccctgctggccctcgggtgctactcccaggtgaaccccctgaccctgaccgccgccgtgctcctgctgatcacgcactacgcgatcatcggccccggcctccaggccaaggccacccgggaggcccagaagcgcaccgccgcggggatcatgaagaacccgaccgtcgacggcatcatgacgatcgacctggaccccgtgatctacgacagcaagttcgagaagcagctgggccaggtgatgctcctggtcctgtgcgccgtgcagctcctgctgatgcggacctcctgggccctctgcgaggccctgaccctggcgaccggccccatcacgaccctctgggagggcagccccgggaagttctggaacaccaccatcgccgtgtccatggccaacatcttccgcggcagctacctggccggggccggcctggcgttctccatcatgaagtccgtcgggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgccgtgtcccggggcagcgccaagctgcagtggttcgtcgagcgcaacatggtgatcccggaggggcgggtgatcgacctcggctgcgggcgcggcgggtggtcctactactgcgccggcctgaagaaggtcaccgaggtgcggggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacgcacgagatgtactggatcagcaacggcaccgggaacatcgtggcgtccgtcaacatggtgagccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggccaccgggtccgcgagcagcatgatcaacggcgtggtgaagctgctgaccaagccctgggacgtcgtgcccatggtgacccagatggccatgacggacaccacccccttcgggcagcagcgcgtcttcaaggagaaggtggacacccggacgccgcgctccatgcccggcacccggcgcgtgatgggcatcaccgccgagtggctctggcggaccctggggcgcaacaagaagccccggctgtgcacgcgcgaggagttcaccaagaaggtccgcaccaacgccgcgatgggcgccgtgttcaccgaggagaaccagtgggacagcgccaaggccgccgtggaggacgaggacttctggaagctcgtcgaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgcggacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcggcagcggccaggtgggcacctacgggctgaacacgttcaccaacatggaggcccagctcatccggcagatggagggcgagggggtgctgtccaaggcggacctggagaacccccacctcagcgagaagaagatcacccagtggctggagaccaagggcgtcgagcgcctgaagcggatggccatctccggcgacgactgcgtggtgaagccgatcgacgaccgcttcgccaacgccctcctggccctgaacgacatggggaaggtccggaaggacatcccccagtggcagcccagcaagggctggcacgactggcagcaggtccccttctgctcccaccacttccacgagctcatcatgaaggacgggcgcaagctggtggtcccgtgccggccccaggacgagctgatcggccgcgcgcggatcagccagggggccggctggtccctccgcgagacggcctgcctgggcaaggcctacgcgcagatgtggagcctgatgtacttccaccgccgggacctccgcctggcctccaacgccatctgcagcgccgtgcccgtgcactgggtccccaccagccggaccacctggtccatccacgcccaccaccagtggatgacgaccgaggacatgctgaccgtgtggaaccgcgtgtggatcgaggacaacccgtggatggaggacaagacccccgtcacgacctgggagaacgtgccctacctcgggaagcgggaggaccagtggtgcggcagcctgatcgggctgacctcccgcgcgacctgggcccagaacatccccacggccatccagcaggtccggagcctcatcggcaacgaggagttcctggactacatgccgtccatgaagcgcttccggaaggaggaggagagcgagggggtcatctggtga

SEQ ID NO: 10160 - RNA, 9873 nt, synthetic construct
  misc_feature 1..9873: note = derived and/or modified CDS sequence (opt1) from DENV-3__FJ182004__SS-prME
  source 1..9873: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgcggtggtgcaggccgacaccgggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgcgggcgcctgggagaacggggtctgcggcatccgcagcacgacccggatggagaacctgctgtggaagcaggtcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgcggagacccagaacagctccttcatcatcgacggccccaacacgcccgagtgccccagcgcctcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgcggtccacgccgacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgcgggcagcgggaaggtggacaacttcacgatgggcgtcctgtgcctcgccatcctgttcgaggaggtgatgcgggggaagttcggcaagaagcacatgatcgccggggtgttcttcaccttcgtcctgctcctgtccggccagatcacctggcgcgacatggcccacaccctgatcatgatcggcagcaacgcctccgaccggatggggatgggcgtgacgtacctcgcgctgatcgccaccttcaagatccagcccttcctggccctcgggttcttcctgcgcaagctgaccagccgggagaacctcctgctgggcgtgggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtcgcgtggcgcacggccaccctgatcctcgccggggtgagcctgctgccggtctgccagtccagctccatgcggaagtccgactggctccccatgaccgtggccgccatgggcgtgccgcccctcccgctgttcatcttctccctcaaggacaccctgaagcgccgcagctggcccctgaacgagggggtcatggcggtgggcctcgtgtccatcctggccagctccctgctccggaacgacgtccccatggccggccccctggtggccgggggcctgctcatcgcctgctacgtgatcacggggaccagcgcggacctgaccgtcgagaaggccgccgacgtgacctgggaggaggaggccgagcagacgggcgtgtcccacaacctgatgatcaccgtcgacgacgacgggaccatgcgcatcaaggacgacgagaccgagaacatcctcaccgtgctgctgaagacggccctcctgatcgtgagcggcatcttcccgtactccatccccgcgaccctgctcgtctggcacacctggcagaagcagacccggcgcagcggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggccagcgtgaagaaggacctgatctcctacggcgggggctggcgcctcagcgcgcagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggctcccccatcatcaaccgggagggcaaggtggtcgggctgtacggcaacggggtggtgaccaagaacggcgggtacgtcagcggcatcgcccagacgaacgcggagccggacggccccacccccgagctggaggaggagatgttcaagaagcgcaacctcaccatcatggacctgcaccccgggtccggcaagacccggaagtacctgccggccatcgtgcgcgaggccatcaagcggcgcctccggacgctgatcctggcccccacccgcgtggtcgccgcggagatggaggaggccctcaaggggctgcccatccggtaccagaccaccgccaccaagagcgagcacaccggccgcgagatcgtggacctgatgtgccacgccaccttcaccatgcggctcctgtcccccgtgcgcgtcccgaactacaacctgatcatcatggacgaggcccacttcacggaccccgcgagcatcgccgcccgggggtacatctccacccgcgtgggcatgggcgaggccgcggccatcttcatgaccgccacgccgcccgggacggccgacgccttcccgcagagcaacgcgcccatccaggacgaggagcgcgacatccccgagcggtcctggaacagcggcaacgagtggatcaccgacttcgccgggaagaccgtgtggttcgtcccctccatcaaggccggcaacgacatcgccaactgcctccgcaagaacgggaagaaggtgatccagctgagccggaagaccttcgacacggagtaccagaagaccaagctgaacgactgggacttcgtggtcaccaccgacatctccgagatgggcgccaacttcaaggcggaccgcgtgatcgacccgcggcgctgcctcaagcccgtgatcctgacggacggccccgagcgggtcatcctggccgggcccatgccggtgaccgccgccagcgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagagccgcaagacgttcgtcgagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctacagcgacccgctggcgctcaaggagttcaaggacttcgccgccggccggaagtccatcgccctggacctggtgacggagatcgggcgcgtccccagccacctcgcccaccggacccgcaacgcgctggacaacctggtgatgctccacaccagcgagcacggcgggaaggcctaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtcatcgcctccagcggcatgctctggatggcggagatcccgctgcagtggatcgcctccgccatcgtgctggagttcttcatgatggtgctcctgatccccgagcccgagaagcagcgcacgccccaggacaaccagctggcctacgtcgtgatcgggatcctcacgctggccgcgatcatcgccgccaacgagatgggcctgctcgagaccaccaagcgggacctgggcatgagcaaggagccgggggtggtctcccccaccagctacctggacgtggacctccaccccgcctccgcgtggacgctgtacgccgtggccaccaccgtcatcacccccatgctgcgccacacgatcgagaacagcaccgccaacgtgtccctcgccgcgatcgccaaccaggccgtggtcctgatgggcctggacaaggggtggccgatcagcaagatggacctcggcgtgcccctgctggccctcgggtgctactcccaggtgaaccccctgaccctgaccgccgcggtcctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcggacctcctgggccctctgcgaggcgctgaccctggccaccggccccatcacgaccctctgggagggcagccccgggaagttctggaacaccaccatcgccgtctccatggccaacatcttccgcggcagctacctggccggggcgggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgccgtctcccggggcagcgccaagctgcagtggttcgtggagcgcaacatggtgatcccggaggggcgggtcatcgacctcggctgcgggcgcggcgggtggtcctactactgcgcgggcctgaagaaggtgaccgaggtgcggggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtcgcctccgtgaacatggtgagccggctcctgctgaaccgcttcaccatgacccaccggcgcccgacgatcgagaaggacgtcgacctcggcgccggcacccggcacgtgaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggcgaccgggtccgccagcagcatgatcaacggcgtggtcaagctgctgaccaagccctgggacgtggtgcccatggtcacccagatggccatgacggacaccacccccttcgggcagcagcgcgtgttcaaggagaaggtggacacccggacgccgcgctccatgcccggcacccggcgcgtcatgggcatcaccgccgagtggctctggcggaccctggggcgcaacaagaagccccggctgtgcacgcgcgaggagttcaccaagaaggtgcgcaccaacgcggccatgggcgccgtgttcaccgaggagaaccagtgggacagcgccaaggccgcggtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtgaaggtccagcgccccacccccaccggcaccgtgatggacatcatctcccggaaggaccagcgcggcagcggccaggtgggcacctacgggctgaacacgttcaccaacatggaggcgcagctcatccggcagatggagggcgagggggtcctgaccaaggccgacctggagaacccccacctctccgagaagaagatcacccagtggctggagacgaagggcgtggagcgcctgaagcggatggccatcagcggcgacgactgcgtggtcaagccgatcgacgaccgcttcgccaacgccctcctggcgctgaacgacatggggaaggtgcggaaggacatcccccagtggcagccctccaagggctggcacgactggcagcaggtccccttctgcagccaccacttccacgagctcatcatgaaggacgggcgcaagctggtcgtgccgtgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtgcccgtccactgggtgcccaccagccggaccacgtggagcatccacgcgcaccaccagtggatgaccaccgaggacatgctgaccgtgtggaaccgcgtctggatcgaggacaacccgtggatggaggacaagacgcccgtgaccacctgggagaacgtgccctacctcgggaagcgggaggaccagtggtgcggctccctgatcgggctgaccagccgcgccacgtgggcccagaacatccccaccgccatccagcaggtccggtccctcatcggcaacgaggagttcctggactacatgccgagcatgaagcgcttccggaaggaggaggagtccgagggggccatctggtga

SEQ ID NO: 10161 - RNA, 9873 nt, synthetic construct
  misc_feature 1..9873: note = derived and/or modified CDS sequence (opt1) from DENV-3__FJ024465__SS-prME
  source 1..9873: mol_type = other RNA
accagcctgtgcctcatgatgatcctgcccgccgccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgacgagcacctgggtgacctacgggacctgcaaccaggccggcgagcaccggcgcgacaagcggtccgtcgcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgcgatcctgttcgaggaggtgatgcgggggaagttcggcaagaagcacatgatcgccggggtgttcttcaccttcgtcctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtcgcctggcgcacggcgaccctgatcctcgccggggtgagcctgctgccggtctgccagtccagctccatgcggaagtccgactggctccccatgaccgtggccgccatgggcgtgccgcccctcccgctgttcatcttctccctcaaggacaccctgaagcgccgcagctggcccctgaacgagggggtcatggccgtgggcctcgtgtccatcctggcgagctccctgctccggaacgacgtccccatggccggccccctggtggccgggggcctgctcatcgcctgctacgtgatcacggggaccagcgccgacctggcggtcgagaaggccgccgacgtgacctgggaggaggaggccgagcagaccggcgtgtcccacaacctgatgatcacggtcgacgacgacgggaccatgcgcatcaaggacgacgagaccgagaacatcctcaccgtgctgctgaagaccgccctcctgatcgtgagcggcatcttcccgtactccatccccgcgacgctgctcgtctggcacacctggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggccagcgtgaagaaggacctgatctcctacggcgggggctggcggctcagcgcgcagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggctcccccatcatcaaccgcgagggcaaggtggtcgggctgtacggcaacggggtggtgaccaagaacggcgggtacgtcagcggcatcgcccagaccaacgcggagccggacggccccacgcccgagctggaggaggagatgttcaagaagcggaacctcaccatcatggacctgcaccccgggtccggcaagacccgcaagtacctgccggccatcgtgcgggaggccatcaagcgccggctccgcaccctgatcctggcccccacgcgggtggtcgccgcggagatggaggaggccctcaaggggctgcccatccgctaccagaccaccgccaccaagagcgagcacacgggccgggagatcgtggacctgatgtgccacgccaccttcaccatgcgcctcctgtcccccgtgcgggtcccgaactacaacctgatcatcatggacgaggcccacttcaccgaccccgcgagcatcgccgcccgcgggtacatctccacgcgggtgggcatgggcgaggccgcggccatcttcatgaccgccacgccgcccgggaccgccgacgccttcccgcagagcaacgcgcccatccaggacgaggagcgcgacatccccgagcgctcctggaacagcggcaacgagtggatcacggacttcgccgggaagaccgtgtggttcgtcccctccatcaaggccggcaacgacatcgccaactgcctccggaagaacgggaagaaggtgatccagctgagccgcaagaccttcgacaccgagtaccagaagacgaagctgaacgactgggacttcgtggtcaccaccgacatctccgagatgggcgccaacttcaaggcggaccgggtgatcgacccgcgccggtgcctcaagcccgtgatcctgaccgacggccccgagcgcgtcatcctggccgggcccatgccggtgacggccgccagcgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagagccggaagaccttcgtcgagctgatgcgccgcggggacctccccgtgtggctggcccacaaggtcgcctccgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggcgctcaaggagttcaaggacttcgccgccggccgcaagtccatcgccctggacctggtgaccgagatcgggcgggtccccagccacctcgcccaccgcacgcggaacgcgctggacaacctggtgatgctccacaccagcgagcacggcgggaaggcctaccgccacgccgtggaggagctgcccgagaccatggagaccctgctcctgctgggcctcatgatcctgctgaccggcggggccatgctgttcctgatctccgggaaggggatcggcaagaccagcatcgggctgatctgcgtcatcgcctccagcggcatgctctggatggcggagatcccgctgcagtggatcgcctccgccatcgtgctggagttcttcatgatggtgctcctgatccccgagcccgagaagcagcggacgccccaggacaaccagctggcctacgtcgtgatcgggatcctcaccctggccgcgatcatcgccgccaacgagatgggcctgctcgagacgaccaagcgcgacctgggcatgagcaaggagccgggggtggtctcccccaccagctacctggacgtggacctccaccccgcctccgcgtggaccctgtacgccgtggccacgaccgtcatcacccccatgctgcggcacaccatcgagaacagcacggccaacgtgtccctcgccgcgatcgccaaccaggccgtggtcctgatgggcctggacaaggggtggccgatcagcaagatggacctcggcgtgcccctgctggccctcgggtgctactcccaggtgaaccccctgaccctgaccgccgcggtcctcctgctgatcacccactacgccatcatcggccccggcctccaggccaaggccacgcgcgaggcccagaagcggaccgcggccgggatcatgaagaacccgaccgtggacggcatcatgaccatcgacctggaccccgtgatctacgacagcaagttcgagaagcagctggggcaggtcatgctcctggtgctgtgcgccgtgcagctcctgctgatgcgcacgtcctgggccctctgcgaggcgctgaccctggccaccggccccatcaccacgctctgggagggcagccccgggaagttctggaacaccaccatcgccgtctccatggccaacatcttccggggcagctacctggccggggcgggcctggccttctccatcatgaagtccgtggggaccggcaagcgcggcacggggagccagggcgagaccctcggggagaagtggaagaagaagctgaaccagctgtcccggaaggagttcgacctctacaagaagtccggcatcaccgaggtggaccgcaccgaggccaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgcgggcctgaagaaggtgacggaggtgcgcggctacaccaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccacggtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcacggggaacatcgtcgcctccgtgaacatggtgagccgcctcctgctgaaccggttcaccatgacccaccgccggccgaccatcgagaaggacgtcgacctcggcgccggcacgcgccacgtgaacgccgagcccgagacccccaacatggacgtgatcggggagcggatcaagcgcatcaaggaggagcacaactccacctggcactacgacgacgagaacccgtacaagacctgggcctaccacggcagctacgaggtcaaggcgacggggtccgccagcagcatgatcaacggcgtggtcaagctgctgaccaagccctgggacgtggtgcccaccgtcacccagatggccatgacggacaccacccccttcgggcagcagcgggtgttcaaggagaaggtggacacccgcacgccgcggtccatgcccggcacccgccgggtcatgggcatcaccgccgagtggctctggcgcaccctggggcggaacaagaagccccgcctgtgcacgcgggaggagttcaccaagaaggtgcgcaccaacgcggccatgggcgccgtgttcaccgaggagaaccagtgggacagcgccaaggccgcggtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgcgatgtacgccgacgacacggccgggtgggacacccggatcaccgaggacgacctgcacaacgaggagaagatcacccagcagatggacccggagcaccgccagctcgccaacgccatcttcaagctgacgtaccagaacaaggtggtgaaggtccagcggcccacccccaccggcaccgtgatggacatcatctcccgcaaggaccagcggggcagcggccaggtgggcacctacgggctgaacacgttcaccaacatggaggcgcagctcatccgccagatggagggcgagggggtcctgtccaaggccgacctggagaacagccacctctccgagaagaagatcacccagtggctggagaccaagggcgtggagcggctgaagcgcatggccatcagcggcgacgactgcgtggtcaagcccatcgacgaccggttcgccaacgccctcctggcgctgaacgacatggggaaggtgcgcaaggacatcccgcagtggcagccctccaagggctggcacgactggcagcaggtccccttctgcagccaccacttccacgagctcatcatgaaggacgggcggaagctggtcgtgccctgccgcccgcaggacgagctgatcggccgggcccgcatctcccagggggccggctggagcctccgggagacggcctgcctgggcaaggcgtacgcccagatgtggtccctgatgtacttccaccgccgcgacctccggctggccagcaacgccatctgcagcgccgtgcccgtccactgggtgcccacctcccgcaccacctggagcatccacgcgcaccaccagtggatgacgaccgaggacatgctgaccgtgtggaaccgggtctggatcgaggacaacccctggatggaggacaagaccccggtgacgacctgggagaacgtgccctacctcgggaagcgcgaggaccagtggtgcggctccctgatcgggctgaccagccgggccacctgggcccagaacatccccacggccatccagcaggtccgctccctcatcggcaacgaggagttcctggactacatgcccagcatgaagcggttccgcaaggaggaggagtccgagggggccatctggtga

SEQ ID NO: 10162 - RNA, 9873 nt, synthetic construct
  misc_feature 1..9873: note = derived and/or modified CDS sequence (opt1) from DENV-3__FJ024466__SS-prME
  source 1..9873: mol_type = other RNA
accagcctgtgcctcatgatgatcctgcccgccgccctggccttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtggagacctgggcgctgcgccacccggggttcacgatcctcgccctgttcctggcccactacatcggcacctccctcacccagaaggtggtgatcttcatcctgctgatgctcgtgacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgcggtggtgcaggccgacaccgggtgcgtcatcaactggaagggcaaggagctgaagtgcggcagcgggatcttcgtgacgaacgaggtgcacacctggaccgagcagtaccgcttccaggccgactcccccaagcgcctcgccaccgccatcgcgggcgcctgggagaacggggtctgcggcatccggagcacgacccgcatggagaacctgctgtggaagcagatcgccaacgagctcaactacatcctgtgggagaacaacatcaagctgaccgtggtggtcggggacatcatcggcgtgctcgagcagggcaagcggaccctgacgccccagccgatggagctgaagtactcctggaagacctgggggaaggccaagatcgtgaccgcggagacccagaacagctccttcatcatcgacggccccaacacgcccgagtgccccagcgcctcccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggcggtgcacgccgacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccgcccgggctaccacacccagaccgccgggccctggcacctcggcaagctggagctggacttcaactactgcgagggcacgaccgtggtcatcaccgacaactgcgggacccggggccccagcctccgcacgaccaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtctccgcgggcagcgggaaggtggacaacttcacgatgggcgtgctgtgcctcgccatcctgttcgaggaggtcatgcgcgggaagttcggcaagaagcacatgatcgccggggtgttcttcaccttcgtgctgctcctgtccggccagatcacctggcgggacatggcccacaccctgatcatgatcggcagcaacgcctccgaccgcatggggatgggcgtcacgtacctcgcgctgatcgccaccttcaagatccagcccttcctggccctcgggttcttcctgcggaagctgaccagccgcgagaacctcctgctgggcgtgggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtggcgtggcggacggccaccctgatcctcgccggggtcagcctgctgccggtgtgccagtccagctccatgcgcaagagcgactggctccccatgaccgtcgccgccatgggcgtgccgcccctcccgctgttcatcttctccctcaaggacaccctgaagcgccggagctggcccctgaacgagggggtgatggcggtcggcctcgtgtccatcctggccagctccctgctccgcaacgacgtgcccatggccggccccctggtcgccgggggcctgctcatcgcctgctacgtgatcacggggaccagcgcggacctgaccgtggagaaggccgccgacgtcacctgggaggaggaggccgagcagacgggcgtgtcccacaacctgatgatcaccgtggacgacgacgggaccatgcggatcaaggacgacgagaccgagaacatcctcaccgtcctgctgaagacggccctcctgatcgtgagcggcatcttcccgtactccatccccgcgaccctgctcgtgtggcacacctggcagaagcagacccgccggagcggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggccagcgtcaagaaggacctgatctcctacggcgggggctggcggctcagcgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggctcccccatcatcaaccgcgagggcaaggtggtggggctgtacggcaacggggtcgtgaccaagaacggcgggtacgtgagcggcatcgcccagacgaacgcggagccggacggccccacccccgagctggaggaggagatgttcaagaagcggaacctcaccatcatggacctgcaccccgggtccggcaagacccgcaagtacctgccggccatcgtccgggaggccatcaagcgccggctccgcacgctgatcctggcccccacccgggtggtggccgcggagatggaggaggccctcaaggggctgcccatccgctaccagaccaccgccaccaagtccgagcacaccggccgggagatcgtcgacctgatgtgccacgccaccttcaccatgcgcctcctgtcccccgtgcgggtgccgaactacaacctgatcatcatggacgaggcccacttcacggaccccgcgagcatcgccgcccgcgggtacatctccacccgcgtcggcatgggcgaggccgcggccatcttcatgaccgccacgccgcccgggacggccgacgccttcccgcagagcaacgcgcccatccaggacgaggagcgggacatccccgagcgctcctggaacagcggcaacgagtggatcaccgacttcgccgggaagaccgtgtggttcgtgccctccatcaaggccggcaacgacatcgccaactgcctccggaagaacgggaagaaggtcatccagctgagccgcaagaccttcgacacggagtaccagaagaccaagctgaacgactgggacttcgtggtgaccaccgacatctccgagatgggcgccaacttcaaggcggaccgggtcatcgacccgcgccggtgcctcaagcccgtgatcctgacggacggccccgagcgcgtgatcctggccgggcccatgccggtcaccgccgccagcgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagagccggaagacgttcgtggagctgatgcgccgcggggacctccccgtctggctggcccacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccgctggctggacgcccggacctacagcgacccgctggcgctcaaggagttcaaggacttcgccgccggccgcaagtccatcgccctggacctggtgacggagatcgggcgggtgcccagccacctcgcccaccgcacccggaacgcgctggacaacctggtcatgctccacaccagcgagcacggcgggaaggcctaccgccacgccgtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggcggagatcccgctgcagtggatcgcctccgccatcgtcctggagttcttcatgatggtgctcctgatccccgagcccgagaagcagcggacgccccaggacaaccagctggcctacgtggtcatcgggatcctcacgctggccgcgatcatcgccgccaacgagatgggcctgctcgagaccaccaagcgcgacctgggcatgagcaaggagccgggggtggtgtcccccaccagctacctggacgtcgacctccaccccgcctccgcgtggacgctgtacgccgtggccaccaccgtgatcacccccatgctgcggcacacgatcgagaacagcaccgccaacgtctccctcgccgcgatcgccaaccaggccgtggtgctgatgggcctggacaaggggtggccgatcagcaagatggacctcggcgtccccctgctggccctcgggtgctactcccaggtgaaccccctgaccctgaccgccgcggtgctcctgctgatcacgcactacgccatcatcggccccggcctccaggccaaggccacccgcgaggcccagaagcggaccgcggccgggatcatgaagaacccgaccgtcgacggcatcatgacgatcgacctggaccccgtgatctacgacagcaagttcgagaagcagctgggccaggtgatgctcctggtcctgtgcgccgtgcagctcctgctgatgcgcacctcctgggccctctgcgaggcgctgaccctggccaccggccccatcacgaccctctgggagggcagccccgggaagttctggaacaccaccatcgccgtgtccatggccaacatcttccggggcagctacctggccggggcgggcctggccttctccatcatgaagtccgtcgggacgggcaagcgcggcaccgggagccagggcgagaccctcggggagaagtggaagaagaagctgaaccagctgtcccggaaggagttcgacctctacaagaagtccggcatcaccgaggtggaccgcaccgaggccaaggaggggctgaagcggggcgagatcacgcaccacgccgtgtcccgcggcagcgccaagctgcagtggttcgtcgagcggaacatggtgatcccggaggggcgcgtgatcgacctcggctgcgggcggggcgggtggtcctactactgcgcgggcctgaagaaggtcaccgaggtgcgcggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgggtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacgcacgagatgtactggatcagcaacggcaccgggaacatcgtggcctccgtcaacatggtgagccgcctcctgctgaaccggttcaccatgacccaccgccggccgacgatcgagaaggacgtggacctcggcgccggcacccgccacgtcaacgccgagcccgagacccccaacatggacgtgatcggggagcggatcaagcgcatcaaggaggagcacaactccacctggcactacgacgacgagaacccgtacaagacgtgggcctaccacggcagctacgaggtgaaggcgaccgggtccgccagcagcatgatcaacggcgtcgtgaagctgctgaccaagccctgggacgtcgtgcccatggtgacccagatggccatgacggacaccacccccttcgggcagcagcgggtcttcaaggagaaggtggacacccgcacgccgcggtccatgcccggcacccgccgggtgatgggcatcaccgccgagtggctctggcgcaccctggggcggaacaagaagccccgcctgtgcacgcgcgaggagttcaccaagaaggtccggaccaacgcggccatgggcgccgtgttcaccgaggagaaccagtgggacagcgccaaggccgcggtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgcgatgtacgccgacgacacggccgggtgggacacccggatcaccgaggacgacctgcacaacgaggagaagatcacccaccagatggacccggagcaccgccagctcgccaacgccatcttcaagctgacgtaccagaacaaggtcgtgaaggtgcagcggcccacccccaccggcaccgtcatggacatcatctcccgcaaggaccagcggggcagcggccaggtgggcacctacgggctgaacacgttcaccaacatggaggcgcagctcatccgccagatggagggcgagggggtgctgtccaaggccgacctggagaacccccacctcagcgagaagaagatcacccagtggctggagaccaagggcgtcgagcggctgaagcgcatggccatctccggcgacgactgcgtggtgaagccgatcgacgaccggttcgccaacgccctcctggcgctgaacgacatggggaaggtccgcaaggacatcccccagtggcagcccagcaagggctggcacgactggcagcaggtccccttctgctcccaccacttccacgagctcatcatgaaggacgggcggaagctggtggtcccgtgccgcccccaggacgagctgatcggccgggcccgcatcagccagggggccggctggtccctccgcgagacggcctgcctgggcaaggcgtacgcccagatgtggagcctgatgtacttccaccggcgcgacctccggctggcctccaacgccatctgcagcgccgtgcccgtgcactgggtccccaccagccgcaccacctggtccatccacgcgcaccaccagtggatgacgaccgaggacatgctgaccgtgtggaaccgggtgtggatcgaggacaacccgtggatggaggacaagacccccgtcacgacctgggagaacgtgccctacctcgggaagcgcgaggaccagtggtgcggcagcctgatcgggctgacctcccgggccacctgggcccagaacatccccacggccatccagcaggtccgcagcctcatcggcaacgaggagttcctggactacatgccgtccatgaagcggttccgcaaggaggaggagagcgagggggccatctggtga

SEQ ID NO: 10163 - RNA, 9873 nt, synthetic construct
  misc_feature 1..9873: note = derived and/or modified CDS sequence (opt1) from DENV-3__FJ024467__SS-prME
  source 1..9873: mol_type = other RNA
accagcctctgcctcatgatggtgctgcccgcggccctggcgttccacctcaccagccgcgacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcggggtgctcctgacctggatcggcctgaacagcaagaacacctccatgagcttctcctgcatcgccatcggggtgatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaaccaccggccgggctaccagacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgcgatcctgttcgaggagatgatgcgggggaagttcggcaagaagcacatgatcgccggggtgttcttcaccttcgtcctgctcctgtccggccagatcacctggcgcgacatggcccacaccctgatcatgatcggcagcaacgcctccgaccggatggggatgggcgtgacgtacctcgccctgatcgcggccttcaagatccagcccttcctggccctcgggttcttcctgcgcaagctgaccagccgggagaacctcctgctgggcgtgggcctcgccatggcgaccaccctgcagctgcccgaggacatcgagcagatggccaacgggatcgccctcggcctgatggccctgaagctcatcacgcagttcgagacctaccagctgtggaccgccctgatcagcctgacctgctccaacacgatgttcaccctgaccgtcgcgtggcgcaccgccacgctgatcctcgccggggtgagcctgctgccggtctgccagtccagctccatgcggaagaccgactggctccccatggccgtggccgcgatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggccggccccctggtggccgggggcctgctcatcgcgtgctacgtgatcaccgggacgtccgccgacctgaccgtcgagaaggccgccgacatcacctgggaggaggaggccgagcagaccggcgtgagccacaacctgatgatcacggtggacgacgacgggaccatgcgcatcaaggacgacgagaccgagaacatcctcaccgtcctgctgaagaccgcgctcctgatcgtgtccggcgtgttcccgtacagcatccccgccacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcgcagaccaacgccgagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtggtcgcggccgagatggaggaggccctcaaggggctgcccatccgctaccagaccaccgccaccaagtccgagcacacgggccgggagatcgtggacctgatgtgccacgccaccttcaccatgcgcctcctgagccccgtgcgggtcccgaactacaacctgatcatcatggacgaggcgcacttcaccgaccccgcctccatcgccgcccgcgggtacatcagcacgcgggtgggcatgggcgaggcggccgccatcttcatgaccgccacgccgcccgggaccgccgacgcgttcccgcagtccaacgcccccatccaggacgaggagaaggacatccccgagcgcagctggaactccggcaacgagtggatcacggacttcgccgggaagaccgtgtggttcgtccccagcatcaaggccggcaacgacatcgccaactgcctccgcaagaacgggaagaaggtgatccagctgtcccggaagaccttcgacaccgagtaccagaagacgaagctgaacgactgggacttcgtggtcaccaccgacatcagcgagatgggcgcgaacttcaaggccgaccgcgtgatcgacccgcggcgctgcctcaagcccgtgatcctgaccgacggccccgagcgggtcatcctggccgggcccatgccggtgacggccgcctccgcggcccagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcccacaaggtcgccagcgagggcatcaagtacacggaccggaagtggtgcttcgacgggcagcgcaacaaccagatcctggaggagaacatggacgtggagatctggaccaaggagggcgagaagaagaagctccggccccgctggctggacgcgcggacctactccgacccgctggccctcaaggagttcaaggacttcgccgccggccgcaagagcatcgccctggacctggtgaccgagatcgggcgcgtcccctcccacctcgcgcaccggacgcgcaacgccctggacaacctggtgatgctccacaccagcgagcacggcgggcgggcctaccgccacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgcgagctccggcatgctctggatggccgagatcccgctgcagtggatcgccagcgccatcgtgctggagttcttcatgatggtgctcctgatccccgagcccgagaagcagcggacgccccaggacaaccagctggcctacgtcgtgatcgggatcctcaccctggcggccatcatcgccgccaacgagatgggcctgctcgagacgaccaagcgcgacctgggcatgtccaaggagccgggggtggtcagccccacctcctacctggacgtggacctccaccccgcgagcgcctggaccctgtacgccgtggccacgaccgtcatcacccccatgctgcggcacaccatcgagaactccacggccaacgtgagcctcgcggccatcgccaaccaggccgtggtcctgatgggcctggacaaggggtggccgatctccaagatggacctcggcgtgcccctgctggccctcgggtgctacagccaggtgaaccccctgaccctgaccgcggccgtcctcctgctgatcacccactacgccatcatcggccccggcctccaggccaaggccacgcgcgaggcgcagaagcggaccgccgccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcgcacgagctgggcgctctgcgaggccctgaccctggccaccggccccatcaccacgctctgggagggctcccccgggaagttctggaacaccaccatcgccgtcagcatggccaacatcttccggggctcctacctggcgggggccggcctggccttcagcatcatgaagtccgtggggaccggcaagcgcggcacggggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagaccacgcaccacgccgtcagccgcggcaccgcgaagctgcagtggttcgtggagcggaacatggtgatcccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcaccatgacgcaccgccggccgaccatcgagaaggacgtcgacctcggcgccggcacccgccacgtgaacgccgagcccgagacccccaacatggacgtgatcggggagcggatcaagcgcatcaaggaggagcacaactccacgtggcactacgacgacgagaacccgtacaagacctgggcgtaccacggcagctacgaggtcaaggccaccgggtccgccagctccatgatcaacggcgtggtcaagctgctgaccaagccctgggacgtggtgcccatggtcacgcagatggccatgaccgacaccacccccttcgggcagcagcgggtgttcaaggagaaggtggacacgcgcaccccgcggagcatgcccggcacccgccgggcgatgggcatcaccgccgagtggctctggcgcacgctggggcggaacaagaagccccgcctgtgcacccgggaggagttcaccaagaaggtccgcaccaacgccgccatgggcgccgtgttcacggaggagaaccagtgggacagcgcgaaggccgccgtggaggacgagaacttctggaagctcgtcgaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtcgtgaaggtgcagcggcccacccccaccggcaccgtcatggacatcatctcccgcaaggaccagcggggcagcggccaggtgggcacgtacgggctgaacaccttcaccaacatggaggcccagctcatccgccagatggagggcgagggggtgctgtccaaggccgacctggagaacccccacctcccggagaagaagatcacccagtggctggagacgaagggcgtcgagcggctgcgccggatggccatcagcggcgacgactgcgtggtgaagcccatcgacgaccgcttcgcgaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcccggatctcccagggggcgggctggagcctccgcgagaccgcctgcctgggcaaggcctacgcccagatgtggtccctgatgtacttccaccgccgggacctccgcctggccagcaacgcgatctgctccgccgtgcccgtgcactgggtcccgaccagccggaccacgtggtccatccacgcccaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgaccagccgcgccacgtgggcccagaacatcccgaccgcgatccagcaggtccggtccctcatcggcaacgaggagttcctggactacatgcccagcatgaagcgcttccggaaggaggaggagtccgagggggccatctggtga

SEQ ID NO: 10164 - RNA, 9873 nt, synthetic construct
  misc_feature 1..9873: note = derived and/or modified CDS sequence (opt1) from DENV-3__FJ024468__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcggggtgatcaccctctacctgggcgccgtggtccaggcggacatggggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgcgatcctgttcgaggaggtgatgcgggggaagttcggcaagaagcacatgatcgccggggtgttcttcaccttcgtcctgctcctgtccggccagatcacctggcgcgacatggcccacaccctgatcatgatcggcagcaacgcctccgacaagatggggatgggcgtgacgtacctcgccctgatcgcgaccttcaagatccagcccttcctggccctcgggttcttcctgcggaagctgaccagccgcgagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtcgcctggcggacggcgaccctgatcctcgccggggtgagcctgctgccggtctgccagtccagctccatgcgcaagaccgactggctccccatggccgtggccgccatgggcgtgccgcccctcccgctgttcatcttcagcctcaaggacaccctgaagcggcgctcctggcccctgaacgagggggtcatggcggtgggcctcgtgagcatcctggcctccagcctgctccgcaacgacgtccccatggccggccccctggtggccgggggcctgctcatcgcctgctacgtgatcacggggacctccgcggacctgaccgtcgagaaggccgccgacatcacctgggaggaggaggccgagcagacgggcgtgagccacaacctgatgatcaccgtggacgacgacgggaccatgcggatcaaggacgacgagaccgagaacatcctcaccgtcctgctgaagacggccctcctgatcgtgtccggcgtgttcccgtacagcatccccgcgaccctgctcgtctggcacacctggcagaagcagacccagcgctccggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcctccgtgaagaaggacctgatcagctacggcgggggctggcgcctctccgcgcagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggcagccccatcatcaaccgggagggcaaggtggtcgggctgtacggcaacggggtggtgaccaagaacggcgggtacgtctccggcatcgcccagacgaacgcggagccggacggccccacccccgagctggaggaggagatgttcaagaagcgcaacctcaccatcatggacctgcaccccgggagcggcaagacccggaagtacctgccggccatcgtgcgcgaggccatcaagcggcgcctccggacgctgatcctggcccccacccgcgtggtcgccgcggagatggaggaggccctcaaggggctgcccatccggtaccagaccaccgccacgaagtccgagcacaccggccgcgagatcgtggacctgatgtgccacgccaccttcaccatgcggctcctgagccccgtgcgcgtcccgaactacaacctgatcatcatggacgaggcccacttcacggaccccgcgtccatcgccgcccgggggtacatcagcacccgcgtgggcatgggcgaggccgcggccatcttcatgaccgccacgccgcccgggacggccgacgccttcccgcagtccaacgcgcccatccaggacgaggagcgggacatccccgagcgcagctggaactccggcaacgagtggatcaccgacttcgccgggaagaccgtgtggttcgtccccagcatcaaggccggcaacgacatcgccaactgcctccgcaagaacgggaagaaggtgatccagctgtcccggaagaccttcgacacggagtaccagaagaccaagctgaacgactgggacttcgtggtcaccaccgacatcagcgagatgggcgccaacttcaaggcggaccgcgtgatcgacccgcggcgctgcctcaagcccgtgatcctgacggacggccccgagcgggtcatcctggccgggcccatgccggtgaccgccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagacgttcgtcgagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccggacctactccgacccgctggcgctcaaggagttcaaggacttcgccgccggccgcaagagcatcgccctggacctggtgacggagatcgggcgcgtcccctcccacctcgcccaccggacccgcaacgcgctggacaacctggtgatgctccacaccagcgagcacggcgggcgggcctaccgccacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcggacgccccaggacaaccagctggcctacgtcgtgatcgggatcctcacgctggccgcgatcatcgccgccaacgagatgggcctgctcgagaccaccaagcgcgacctgggcatgtccaaggagccgggggtggtcagccccacctcctacctggacgtggacctccaccccgccagcgcgtggacgctgtacgccgtggccaccaccgtcatcacccccatgctgcggcacacgatcgagaactccaccgccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacgcactacgccatcatcggccccggcctccaggccaaggccacccgcgaggcccagaagcggaccgcggccgggatcatgaagaacccgaccgtggacggcatcatgacgatcgacctggaccccgtgatctacgactccaagttcgagaagcagctggggcaggtcatgctcctggtgctgtgcgccgtgcagctcctgctgatgcgcaccagctgggccctctgcgaggcgctgaccctggccaccggccccatcacgaccctctgggagggctcccccgggaagttctggaacaccaccatcgccgtcagcatggccaacatcttccggggctcctacctggccggggcgggcctggccttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagacgacccaccacgccgtcagccgcggcaccgccaagctgcagtggttcgtggagcggaacatggtgatcccggaggggcgcgtcatcgacctcggctgcgggcggggcgggtggtcctactactgcgcgggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgccggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggcgaccgggtccgccagctccatgatcaacggcgtggtcaagctgctgacgaagccctgggacgtggtgcccatggtcacccagatggccatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgcggccatgggcgccgtgttcaccgaggagaaccagtgggacagcgccaaggccgcggtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgcgatgtacgccgacgacaccgccgggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatctcccgcaaggaccagcggggcagcggccaggtgggcacctacgggctgaacaccttcaccaacatggaggcgcagctcatccgccagatggagggcgagggggtcctgtccaaggccgacctggagaacccccacctcccggagaagaagatcacgcagtggctggagaccaagggcgtggagcggctgcgccggatggccatcagcggcgacgactgcgtggtcaagcccatcgacgaccgcttcgccaacgccctcctggcgctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtgcccgtccactgggtgccgaccagccggacgacctggtccatccacgcgcaccaccagtggatgaccaccgaggacatgctgacggtgtggaaccgcgtctggatcgaggacaacccctggatggaggacaagacccccgtgaccacctgggagaacgtgccctacctcgggaagcgggaggaccagtggtgcggcagcctgatcgggctgacgagccgcgccacctgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10165 - RNA, 9873 nt, synthetic construct
  misc_feature 1..9873: note = derived and/or modified CDS sequence (opt1) from DENV-3__FJ024470__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgcgaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgccgtgctcacgtacaacgggaagcgcctggagcccaactgggcctccgtgaagaaggacctgatcagctacggcgggggctggcggctctccgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgcggagccggacggccccacccccgagctggaggaggagatgttcaagaagcggaacctcaccatcatggacctgcaccccgggagcggcaagacccgcaagtacctgccggccatcgtgcgggaggccatcaagcgccggctccgcacgctgatcctggcccccacccgggtcgtggccgcggagatggaggaggccctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcgtccatcgccgcccgcgggtacatcagcacccgggtgggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtctggttcgtgcccagcatcaaggccggcaacgacatcgccaactgcctccggaagaacgggaagaaggtgatccagctgtcccgcaagaccttcgacacggagtaccagaagaccaagctgaacgactgggacttcgtcgtgaccaccgacatcagcgagatgggcgccaacttcaaggcggaccgggtgatcgacccgcgccggtgcctcaagcccgtcatcctgacggacggccccgagcgcgtgatcctggccgggcccatgccggtgaccgccgcctccgccgcgcagcggcgcggccgggtcgggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtcacggagatcgggcgggtgccctcccacctcgcccaccgcacccggaacgcgctggacaacctggtgatgctccacaccagcgagcacggcgggcgcgcctaccggcacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcgcacgccccaggacaaccagctggcctacgtggtgatcgggatcctcacgctggccgcgatcatcgccgccaacgagatgggcctgctcgagaccaccaagcgggacctgggcatgtccaaggagccgggggtcgtgagccccacctcctacctggacgtggacctccaccccgccagcgcgtggacgctgtacgccgtcgccaccaccgtgatcacccccatgctgcgccacacgatcgagaactccaccgccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtcatctacgactccaagttcgagaagcagctgggccaggtgatgctcctggtgctgtgcgccgtccagctcctgctgatgcggaccagctgggccctctgcgaggcgctgaccctggccaccggccccatcacgaccctctgggagggctcccccgggaagttctggaacaccaccatcgccgtgagcatggccaacatcttccgcggctcctacctggccggggcgggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagatcacgcaccacgccgtgagccggggctccgccaagctgcagtggttcgtggagcgcaacatggtcatcccggaggggcgggtgatcgacctcggctgcgggcgcggcgggtggagctactactgcgcgggcctgaagaaggtgaccgaggtccggggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggccagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggactccgccaaggccgcggtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcgcagctcatccggcagatggagggcgagggggtgctgagcaaggccgacctggagtcccaccacctccccgagaagaagatcacccagtggctggagaccaagggcgtggagcgcctgaagcggatggccatcagcggcgacgactgcgtcgtgaagccgatcgacgaccgcttcgccaacgccctcctggcgctgaacgacatggggaaggtgcggaaggacatcccccagtggcagccctccaagggctggcacgactggcagcaggtccccttctgcagccaccacttccacgagctcatcatgaaggacgggcgcaagctggtggtgccgtgccggccccaggacgagctgatcggccgcgcccggatctcccagggggccggctggagcctccgcgagacggcctgcctgggcaaggcgtacgcccagatgtggtccctgatgtacttccaccgccgggacctccgcctggccagcaacgccatctgctccgccgtccccgtgcactgggtgcccaccagccggaccacctggagcatccacgcgcaccaccagtggatgacgaccgaggacatgctgaccgtctggaaccgcgtgtggatcgaggacaacccgtggatggaggacaagacccccgtgacgacctgggagaacgtcccctacctcgggaagcgggaggaccagtggtgcggctccctgatcgggctgaccagccgcgccacctgggcccagaacatccccacggccatccagcaggtccggtccctcatcggcaacgaggagttcctggactacatgccgagcatgaagcgcttccggaaggaggaggagtccgagggggccatctggtga

SEQ ID NO: 10166 - RNA, 9873 nt, synthetic construct
  misc_feature 1..9873: note = derived and/or modified CDS sequence (opt1) from DENV-3__FJ024471__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcacggggacctccgcggacctgaccgtggagaaggccgccgacatcacctgggaggaggaggccgagcagacgggcgtcagccacaacctgatgatcaccgtggacgacgacgggaccatgcgcatcaaggacgacgagaccgagaacatcctcaccgtgctgctgaagacggccctcctgatcgtctccggcatcttcccgtacagcatccccgcgaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgccgtgctcacgtacaacgggaagcgcctggagcccaactgggcctccgtgaagaaggacctgatcagctacggcgggggctggcggctctccgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgcggagccggacggccccacccccgagctggaggaggagatgttcaagaagcggaacctcaccatcatggacctgcaccccgggagcggcaagacccgcaagtacctgccggccatcgtgcgggaggccatcaagcgccggctccgcacgctgatcctggcccccacccgggtcgtggccgcggagatggaggaggccctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcgtccatcgccgcccgcgggtacatcagcacccgggtgggcatgggcgaggccgcggccatcttcatgaccgccacgccgcccgggacggccgacgccttcccgcagtccaacgcgcccatccaggacgaggagcgcgacatccccgagcgcagctggaactccggcaacgagtggatcaccgacttcgccgggaagaccgtctggttcgtgcccagcatcaaggccggcaacgacatcgccaactgcctccggaagaacgggaagaaggtgatccagctgtcccgcaagaccttcaacacggagtaccagaagaccaagctgaacgactgggacttcgtcgtgaccaccgacatcagcgagatgggcgccaacttcaaggcggaccgggtgatcgacccgcgccggtgcctcaagcccgtcatcctgacggacggccccgagcgcgtgatcctggccgggcccatgccggtgaccgccgcctccgccgcgcagcggcgcggccgggtcgggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagacgttcgtggagctgatgcgccgcggggacctccccgtgtggctggcccacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtcacggagatcgggcgggtgccctcccacctcgcccaccgcacccggaacgcgctggacaacctggtgatgctccacaccagcgagcacggcgggcgcgcctaccggcacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcgcacgccccaggacaaccagctggcctacgtggtgatcgggatcctcacgctggccgcgatcatcgccgccaacgagatgggcctgctcgagaccaccaagcgggacctgggcatgtccaaggagccgggggtcgtgagccccacctcctacctggacgtggacctccaccccgccagcgcgtggacgctgtacgccgtcgccaccaccgtgatcacccccatgctgcgccacacgatcgagaactccaccgccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtcatctacgactccaagttcgagaagcagctgggccaggtgatgctcctggtgctgtgcgccgtccagctcctgctgatgcggaccagctgggccctctgcgaggcgctgaccctggccaccggccccatcacgaccctctgggagggctcccccgggaagttctggaacaccaccatcgccgtgagcatggccaacatcttccgcggctcctacctggccggggcgggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagatcacgcaccacgccgtgagccggggctccgccaagctgcagtggttcgtggagcgcaacatggtcatcccggaggggcgggtgatcgacctcggctgcgggcgcggcgggtggagctactactgcgcgggcctgaagaaggtgaccgaggtccggggctacaccaagggcgggcccgggcacgaggagcccgtgcccatgtccacctacggctggaacatcgtgaagctgatgagcgggaaggacgtcttctacctcccgcccgagaagtgcgacacgctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacgcacgagatgtactggatctccaacggcaccgggaacatcgtggccagcgtgaacatggtctcccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggcgaccgggagcgcctccagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgcagcatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggactccgccaaggccgcggtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcgcagctcatccggcagatggagggcgagggggtgctgagcaaggccgacctggagtcccaccacctcagcgagaagaagatcacccagtggctggagaccaagggcgtggagcgcctgaagcggatggccatctccggcgacgactgcgtcgtgaagcccatcgacgaccgcttcgccaacgccctcctggcgctgaacgacatggggaaggtgcggaaggacatcccgcagtggcagcccagcaagggctggcacgactggcagcaggtccccttctgctcccaccacttccacgagctcatcatgaaggacgggcgcaagctggtggtgccctgccggccgcaggacgagctgatcggccgcgcccggatcagccagggggccggctggtccctccgcgagacggcctgcctgggcaaggcgtacgcccagatgtggagcctgatgtacttccaccgccgggacctccgcctggcctccaacgccatctgcagcgccgtccccgtgcactgggtgcccaccagccggaccacctggtccatccacgcgcaccaccagtggatgacgaccgaggacatgctgaccgtctggaaccgcgtgtggatcgaggacaacccctggatggaggacaagaccccggtgacgacctgggagaacgtcccctacctcgggaagcgggaggaccagtggtgcggcagcctgatcgggctgacctcccgcgccacctgggcccagaacatccccacggccatccagcaggtccggagcctcatcggcaacgaggagttcctggactacatgccctccatgaagcgcttccggaaggaggaggagagcgagggggccatctggtga

SEQ ID NO: 10167 - RNA, 9873 nt, synthetic construct
  misc_feature 1..9873: note = derived and/or modified CDS sequence (opt1) from DENV-3__FJ182005__SS-prME
  source 1..9873: mol_type = other RNA
accagcctctgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaaggtgcccttcagcaccgaggacgggcagggcaaggcgcacagcggccgcctgatcacggccaaccccgtggtcaccaagaaggaggagcccgtgaacatcgaggccgagccgcccttcggggagtccaacatcgtgatcggcatcggggacaacgccctgaagatcaactggtacaagaagggcagctccatcgggaagatgttcgaggcgaccgcccggggcgcccgccggatggccatcctgggcgacaccgcctgggacttcgggagcgtcggcggggtgctcaactccctgggcaagatggtgcaccagatcttcgggagcgcgtacacggccctgttctccggcgtcagctgggtgatgaagatcggcatcgggatcctcctgacctggatcggcctgaactccaagaacaccagcatgtccttcagctgcatcgtgatcgggatcatcaccctctacctgggcgccgtcgtgcaggccgacatggggtgcgtgatcaactggaagggcaaggagctgaagtgcggctccgggatcttcgtcacgaacgaggtgcacacctggaccgagcagtacaagttccaggccgacagccccaagcgcctcgcgaccgccatcgccggcgcctgggagaacggggtgtgcggcatccgctccacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtacagctggaaggcgtgggggaaggccaagatcgtgaccgccgagacccagaactccagcttcatcatcgacggccccaacacccccgagtgcccctccgccagccgggcgtggaacgtgtgggaggtcgaggactacgggttcggcgtgttcacgaccaacatctggctcaagctgcgcgaggtgtacacccagctgtgcgaccaccggctcatgagcgccgccgtcaaggacgagcgcgccgtgcacgccgacatgggctactggatcgagtcccagaagaacgggagctggaagctggagaaggcgtccctgatcgaggtgaagacctgcacctggcccaagtcccacacgctctggtccaacggcgtcctggagagcgacatgatcatccccaagtccctggccgggcccatcagccagcacaactaccggccgggctaccacacccagaccgccgggccctggcacctcggcaagctggagctggacttcaactactgcgagggcaccacggtggtgatcaccgagaactgcgggacccgcggcccctccctccggaccacgaccgtcagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtgagcgccggctccgggaaggtcgacaacttcaccatgggcgtgctgtgcctcgccatcctgttcgaggaggtgatgcgggggaagttcggcaagaagcacatgatcgcgggggtcttcttcacgttcgtgctgctcctgagcggccagatcacctggcgcgacatggcccacaccctgatcatgatcggctccaacgccagcgaccggatggggatgggcgtgacctacctcgccctgatcgccacgttcaagatccagcccttcctggcgctcgggttcttcctgcgcaagctgaccagccgggagaacctcctgctgggcgtcggcctcgccatggccaccaccctgcagctgcccgaggacatcgagcagatggccaacgggatcgcgctcggcctgatggccctgaagctcatcacgcagttcgagacctaccagctgtggaccgccctgatctccctgacctgcagcaacacgatcttcaccctgaccgtggcctggcgcaccgccacgctgatcctcgcgggggtctccctgctgccggtgtgccagagctccagcatgcggaagaccgactggctccccatgaccgtggccgccatgggcgtgccgcccctcccgctgttcatcttctccctcaaggacaccctgaagcgccgcagctggcccctgaacgagggggtgatggccgtgggcctcgtctccatcctggccagctccctgctccggaacgacgtgcccatggcgggccccctggtggccgggggcctgctcatcgcctgctacgtcatcacggggaccagcgccgacctgaccgtggagaaggccgcggacgtgacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcatcttcccgtactccatccccgccaccctgctcgtgtggcacacctggcagaagcagacccagcggagcggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggccagcgtgaagaaggacctgatctcctacggcgggggctggcggctcagcgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggaccagcggctcccccatcatcaaccgcgagggcaaggtcgtggggctgtacggcaacggggtggtcaccaagaacggcgggtacgtgagcggcatcgcccagacgaacgccgagccggacggccccacccccgagctggaggaggagatgttcaagaagcggaacctcaccatcatggacctgcaccccgggtccggcaagacccgcaagtacctgccggccatcgtgcgggaggcgatcaagcgccggctccgcacgctgatcctggcccccacccgggtcgtggccgccgagatggaggaggccctcaaggggctgcccatccgctaccagaccaccgcgaccaagagcgagcacaccggccgggagatcgtggacctgatgtgccacgccaccttcaccatgcgcctcctgtcccccgtccgggtgccgaactacaacctgatcatcatggacgaggcccacttcacggaccccgccagcatcgccgcgcgcgggtacatctccacccgggtgggcatgggcgaggccgccgccatcttcatgaccgcgacgccgcccgggacggccgacgccttcccgcagagcaacgcccccatccaggacgaggagcgcgacatccccgagcgctcctggaacagcggcaacgagtggatcaccgacttcgccgggaagaccgtctggttcgtgccctccatcaaggcgggcaacgacatcgccaactgcctccggaagaacgggaagaaggtgatccagctgagccgcaagaccttcgacacggagtaccagaagaccaagctgaacgactgggacttcgtcgtgaccaccgacatctccgagatgggcgccaacttcaaggccgaccgggtgatcgacccgcgccggtgcctcaagcccgtcatcctgacggacggccccgagcgcgtgatcctggccgggcccatgccggtgaccgcggccagcgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagacgttcgtggagctgatgcgccgcggggacctccccgtctggctggcgcacaaggtggcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggccctcaaggagttcaaggacttcgccgcgggccgcaagtccatcgccctggacctggtcacggagatcgggcgggtgcccagccacctcgcccaccgcacccggaacgccctggacaacctggtgatgctccacaccagcgagcacggcgggcgcgcctaccggcacgcggtcgaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcgcacgccccaggacaaccagctggcctacgtggtgatcgggatcctcacgctggccgccatcatcgccgcgaacgagatgggcctgctcgagaccaccaagcgggacctgggcatgagcaaggagccgggggtcgtgtcccccaccagctacctggacgtggacctccaccccgcctccgcctggacgctgtacgccgtcgcgaccaccgtgatcacccccatgctgcgccacacgatcgagaacagcaccgccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgaccctgaccgccgccgtgctcctgctgatcacgcactacgccatcatcggccccggcctccaggcgaaggccacccgggaggcccagaagcgcaccgccgccgggatcatgaagaacccgaccgtggacggcatcatgacgatcgacctggaccccgtcatctacgacagcaagttcgagaagcagctgggccaggtgatgctcctggtgctgtgcgcggtccagctcctgctgatgcggacctcctgggccctctgcgaggccctgaccctggccaccggccccatcacgaccctctgggagggcagccccgggaagttctggaacaccaccatcgcggtgtccatggccaacatcttccgcggcagctacctggccggggccggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtcgaccggaccgaggcgaaggaggggctgaagcgcggcgagatcacgcaccacgccgtgtcccggggcagcgccaagctgcagtggttcgtggagcgcaacatggtcatcccggaggggcgggtgatcgacctcggctgcgggcgcggcgggtggtcctactactgcgccggcctgaagaaggtgaccgaggtccggggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacgcacgagatgtactggatcagcaacggcaccgggaacatcgtggcctccgtgaacatggtcagccggctcctgctgaaccgcttcaccatgacccaccggcgcccgacgatcgagaaggacgtggacctcggcgcgggcacccggcacgtgaacgccgagcccgagacccccaacatggacgtcatcggggagcgcatcaagcggatcaaggaggagcacaactccacctggcactacgacgacgagaacccgtacaagacgtgggcctaccacggcagctacgaggtgaaggccaccgggtccgccagcagcatgatcaacggcgtcgtgaagctgctgaccaagccctgggacgtggtccccatggtgacccagatggcgatgacggacaccacccccttcgggcagcagcgcgtgttcaaggagaaggtcgacacccggacgccgcgctccatgcccggcacccggcgcgtgatgggcatcaccgccgagtggctctggcggaccctggggcgcaacaagaagccccggctgtgcacgcgcgaggagttcaccaagaaggtgcgcaccaacgccgccatgggcgcggtcttcaccgaggagaaccagtgggacagcgccaaggccgccgtggaggacgaggacttctggatcctcgtggaccgggagcgcgagctgcacaagctggggaagtgcggctcctgcgtctacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacacggcggggtgggacacccgcatcaccgaggacgacctgcacaacgaggagaagatcacccagcagatggacccggagcaccggcagctcgcctccgccatcttcaagctgacgtaccagaacaaggtggtcaaggtgcagcgccccacccccaccggcaccgtgatggacatcatcagccggaaggaccagcgcggctccgggcaggtcggcacctacgggctgaacacgttcaccaacatggaggcccagctcatccggcagatggagggcgagggggtgctgagcaaggccgacctggagaacccccacctcccggagaagaagatcacccagtggctggagaccaagggcgtggagcgcctgaagcggatggcgatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggcgggctggtccctccgcgagacggcctgcctgggcaaggcctacgcccagatgtggagcctgatgtacttccaccgccgggacctccgcctggcgtccaacgccatctgcagcgccgtccccgtgcactgggtgccgaccagccggaccacctggtccatccacgcccaccaccagtggatgacgaccgaggacatgctgaccgtctggaaccgcgtgtggatcgaggacaacccctggatggaggacaagacccccgtgacgacctgggagaacgtcccctacctcgggaagcgggaggaccagtggtgcggcagcctgatcgggctgacctcccgcgccacctgggcgcagaacatcccgacggccatccagcaggtccggagcctcatcggcaacgaggagttcctggactacatgccctccatgaagcgcttccggaaggaggaggagagcgagggggccatctggtga

SEQ ID NO: 10168 - RNA, 9873 nt, synthetic construct
  misc_feature 1..9873: note = derived and/or modified CDS sequence (opt1) from DENV-3__FJ373302__SS-prME
  source 1..9873: mol_type = other RNA
accagcctgtgcctcatgatgatcctgcccgccgccctggcgttccacctcaccagccgcgacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcggcaggtcgagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgcggtggtgcaggccgacaccgggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgcgggcgcctgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggcctacacccagctgtgcgaccaccggctcatgagcgccgcggtcaaggacgagcgcgccgtgcacgccgacatgggctactggatcgagagccagaagaaggggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgcggggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcgtccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggccctgaagctcatcacccagttcgagacctaccagctgtggaccgcgctgatcagcctcacgtgctccaacaccatcttcaccctgaccgtggcctggcgcacggccaccctgatcctcgccggggtgagcctgctgccggtctgccagtccagctccatgcggaagtccgactggctccccatgaccgtggccgcgatgggcgtgccgcccctcccgctgttcatcttctccctcaaggacaccctgaagcgccgcagctggcccctgaacgagggggtgatggccgtgggcctcgtctccatcctggccagctccctgctccggaacgacgtgcccatggccggccccctggtggccgggggcctgctcatcgcgtgctacgtcatcacggggaccagcgccgacctgaccgtggagaaggccgccgacgtgacctgggaggaggaggccgagcagacgggcgtctcccacaacctgatgatcaccgtggacgacgacgggaccatgcgcatcaaggacgacgagaccgagaacatcctcaccgtgctgctgaagacggcgctcctgatcgtcagcggcatcttcccgtactccatccccgccaccctgctcgtgtggcacacctggcagaagcagacccggcgcagcggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggcgagcgtgaagaaggacctgatctcctacggcgggggctggcgcctcagcgcccagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggctcccccatcatcaaccgggagggcaaggtcgtggggctgtacggcaacggggtggtcaccaagaacggcgggtacgtgagcggcatcgcgcagacgaacgccgagccggacggccccacccccgagctggaggaggagatgttcaagaagcgcaacctcaccatcatggacctgcaccccgggtccggcaagacccggaagtacctgccggccatcgtgcgcgaggccatcaagcggcgcctccggacgctgatcctggcccccacccgcgtcgtggcggccgagatggaggaggccctcaaggggctgcccatccggtaccagaccaccgccaccaagagcgagcacaccggccgcgagatcgtggacctgatgtgccacgccaccttcaccatgcggctcctgtcccccgtccgcgtgccgaactacaacctgatcatcatggacgaggcgcacttcacggaccccgccagcatcgccgcccgggggtacatctccacccgcgtgggcatgggcgaggcggccgccatcttcatgaccgccacgccgcccgggacggccgacgcgttcccgcagagcaacgcccccatccaggacgaggagcgcgacatccccgagcggtcctggaacagcggcaacgagtggatcaccgacttcgccgggaagaccgtctggttcgtgccctccatcaaggccggcaacgacatcgccaactgcctccgcaagaacgggaagaaggtgatccagctgagccggaagaccttcgacacggagtaccagaagaccaagctgaacgactgggacttcgtcgtgaccaccgacatctccgagatgggcgcgaacttcaaggccgaccgcgtgatcgacccgcggcgctgcctcaagcccgtcatcctgacggacggccccgagcgggtgatcctggccgggcccatgccggtgaccgccgccagcgcggcccagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagagccgcaagacgttcgtggagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcgcgcacctacagcgacccgctggccctcaaggagttcaaggacttcgccgccggccggaagtccatcgccctggacctggtcacggagatcgggcgcgtgcccagccacctcgcgcaccggacccgcaacgccctggacaacctggtgatgctccacaccagcgagcacggcgggaaggcctaccggcacgccgtcgaggagctgcccgagaccatggagacgctgctcctgctgggcctcatgatcctgctgaccgggggcgccatgctgttcctgatctccggcaaggggatcggcaagaccagcatcgggctgatctgcgtgatcgcgtccagcggcatgctctggatggccgagatcccgctgcagtggatcgcctccgccatcgtgctggagttcttcatgatggtcctcctgatccccgagcccgagaagcagcgcacgccccaggacaaccagctggcctacgtggtgatcgggatcctcacgctggcggccatcatcgccgccaacgagatgggcctgctcgagaccaccaagcgggacctgggcatgagcaaggagccgggggtcgtgtcccccaccagctacctggacgtggacctccaccccgcgtccgcctggacgctgtacgccgtcgccaccaccgtgatcacccccatgctgcgccacacgatcgagaacagcaccgccaacgtgtccctcgcggccatcgccaaccaggccgtcgtgctgatgggcctggacaaggggtggccgatcagcaagatggacctcggcgtgcccctgctggccctcgggtgctactcccaggtcaaccccctgaccctgaccgcggccgtgctcctgctgatcacgcactacgccatcatcggccccggcctccaggccaaggccacccgggaggcgcagaagcgcaccgccgccgggatcatgaagaacccgaccgtggacggcatcatgacgatcgacctggaccccgtcatctacgacagcaagttcgagaagcagctgggccaggtgatgctcctggtgctgtgcgccgtccagctcctgctgatgcggacctcctgggcgctctgcgaggccctgaccctggccaccggccccatcacgaccctctgggagggcagccccgggaagttctggaacaccaccatcgccgtgtccatggccaacatcttccgcggcagctacctggcgggggccggcctggccttctccatcatgaagtccgtggggacgggcaagcggggcaccgggagcaagggcgagaccctcggggagaagtggaagaagaagctgaaccagctgtcccgcaaggagttcgacctctacaagaagtccggcatcaccgaggtcgaccggaccgaggccaaggaggggctgaagcgcggcgagatcacgcaccacgccgtgtcccggggcagcgcgaagctgcagtggttcgtggagcgcaacatggtcatcccggaggggcgggtgatcgacctcggctgcgggcgcggcgggtggtcctactactgcgccggcctgaagaaggtgaccgaggtccggggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacgcacgagatgtactggatcagcaacggcaccgggaacatcgtggcctccgtgaacatggtcagccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaactccacctggcactacgacgacgagaacccgtacaagacgtgggcgtaccacggcagctacgaggtgaaggccaccgggtccgccagcagcatgatcaacggcgtggtcaagctgctgaccaagccctgggacgtggtccccatggtgacccagatggccatgacggacaccacccccttcgggcagcagcgcgtgttcaaggagaaggtcgacacccggacgccgcgctccatgcccggcacccggcgcgtgatgggcatcaccgcggagtggctctggcggaccctggggcgcaacaagaagccccggctgtgcacgcgcgaggagttcaccaagaaggtgcgcaccaacgccgccatgggcgccgtcttcaccgaggagaaccagtgggacagcgccaaggcggccgtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgccatctggtacatgtggctgggcgcccggtacctggagttcgaggcgctcgggttcctgaacgaggaccactggttctcccgcgagaacagctactccggcgtggagggggagggcctgcacaagctcggctacatcctgcgggacatcagcaagatccccgggggcgccatgtacgccgacgacacggccgggtgggacacccgcatcaccgaggacgacctgcacaacgaggagaagatcacccagcagatggacccggagcaccggcagctcgccaacgcgatcttcaagctgacgtaccagaacaaggtggtcaaggtgcagcgccccacccccaccggcaccgtgatggacatcatctcccggaaggaccagcgcggcagcgggcaggtcggcacctacgggctgaacacgttcaccaacatggaggcccagctcatccggcagatggagggcgagggggtgctgtccaaggccgacctggagaacccccacctcagcgagaagaagatcacccagtggctggagaccaagggcgtggagcgcctgaagcggatggccatctccggcgacgactgcgtcgtgaagccgatcgacgaccgcttcgccaacgcgctcctggccctgaacgacatggggaaggtgcggaaggacatcccccagtggcagcccagcaagggctggcacgactggcagcaggtccccttctgctcccaccacttccacgagctcatcatgaaggacgggcgcaagctggtggtgccgtgccggccccaggacgagctgatcggccgcgcccggatcagccagggggccggctggtccctccgcgagacggcgtgcctgggcaaggcctacgcccagatgtggagcctgatgtacttccaccgccgggacctccgcctggcctccaacgccatctgcagcgcggtccccgtgcactgggtgcccaccagccggaccacctggtccatccacgcccaccaccagtggatgacgaccgaggacatgctgaccgtctggaaccgcgtgtggatcgaggacaacccgtggatggaggacaagacccccgtgacgacctgggagaacgtcccctacctcgggaagcgggaggaccagtggtgcggcagcctgatcgggctgacctcccgcgccacctgggcccagaacatccccacggccatccagcaggtccggagcctcatcggcaacgaggagttcctggactacatgccgtccatgaagcgcttccggaaggaggaggagagcgagggggcgatctggtga

SEQ ID NO: 10169 - RNA, 9873 nt, synthetic construct
  misc_feature 1..9873: note = derived and/or modified CDS sequence (opt1) from DENV-3__FJ182007__SS-prME
  source 1..9873: mol_type = other RNA
accagcctctgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtggagacctgggcgctgcgccacccggggttcacgatcctcgccctgttcctggcccactacatcggcacctccctcacccagaaggtggtgatcttcatcctgctgatgctcgtgacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcaccggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgcggtggtgcaggccgacacggggtgcgtcatcaactggaagggcaaggagctgaagtgcggcagcgggatcttcgtgaccaacgaggtgcacacctggaccgagcagtacaagttccaggccgactcccccaagcgcctcgccacggccatcgcgggcgcctgggagaacggggtctgcggcatccgcagcaccacccggatggagaacctgctgtggaagcagatcgccaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgcggagacgcagaacagctccttcatcatcgacggccccaacacccccgagtgccccagcgcctcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgcggtgcacgccgacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtggtcatcaccgaggactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgcgggcagcgggaaggtggacaacttcaccatgggcgtgctgtgcctcgccatcctgttcgaggaggtcatgcgggggaagttcggcaagaagcacatgatcgccggggtgttcttcaccttcgtgctgctcctgtccggccagatcacctggcgcgacatggcccacacgctgatcatgatcggcagcaacgcctccgaccggatggggatgggcgtcacctacctcgcgctgatcgccaccttcaagatccagcccttcctggccctcgggttcttcctgcgcaagctgaccagccgggagaacctcctgctgggcgtgggcctcgccatggcgacgaccctgcagctgcccgaggacatcgagcagatggccaacgggatcgccctcggcctgatggccctgaagctcatcacccagttcgagacctaccagctgtggacggccctgatcagcctgacctgctccaacaccatcttcaccctgacggtggcgtggcgcaccgccaccctgatcctcgccggggtcagcctgctgccggtgtgccagtccagctccatgcggaagtccgactggctccccatgaccgtcgccgccatgggcgtgccgcccctcccgctgttcatcttctccctcaaggacacgctgaagcgccgcagctggcccctgaacgagggggtgatggcggtcggcctcgtgtccatcctggccagctccctgctccggaacgacgtgcccatggccggccccctggtcgccgggggcctgctcatcgcctgctacgtgatcaccgggaccagcgcggacctgaccgtggagaaggccgccgacgtcacgtgggaggaggaggccgagcagaccggcgtgtcccacaacctgatgatcaccgtggacgacgacgggaccatgcgcatcaaggacgacgagaccgagaacatcctcacggtcctgctgaagaccgccctcctgatcgtgagcggcatcttcccgtactccatccccgcgaccctgctcgtgtggcacacctggcagaagcagacgcggcgcagcggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagcccaactgggccagcgtcaagaaggacctgatctcctacggcgggggctggcgcctcagcgcgcagtggcagaagggggaggaggtccaggtgatcgccgtcgagcccggcaagaaccccaagaacttccagaccatgcccggcaccttccagacgaccaccggggagatcggcgccatcgccctggacttcaagcccgggaccagcggctcccccatcatcaaccgggagggcaaggtggtggggctgtacggcaacggggtcgtgacgaagaacggcgggtacgtgagcggcatcgcccagaccaacgcggagccggacggccccacccccgagctggaggaggagatgttcaagaagcgcaacctcaccatcatggacctgcaccccgggtccggcaagacgcggaagtacctgccggccatcgtccgcgaggccatcaagcggcgcctccggaccctgatcctggcccccacccgcgtggtggccgcggagatggaggaggccctcaaggggctgcccatccggtaccagaccacggccaccaagagcgagcacaccggccgcgagatcgtcgacctgatgtgccacgccaccttcacgatgcggctcctgtcccccgtgcgcgtgccgaactacaacctgatcatcatggacgaggcccacttcaccgaccccgcgagcatcgccgcccgggggtacatctccacccgcgtcggcatgggcgaggccgcggccatcttcatgaccgccacgccgcccgggaccgccgacgccttcccgcagagcaacgcgcccatccaggacgaggagcgcgacatccccgagcggtcctggaacagcggcaacgagtggatcaccgacttcgccgggaagaccgtgtggttcgtgccctccatcaaggccggcaacgacatcgccaactgcctccgcaagaacgggaagaaggtcatccagctgagccggaagacgttcgacaccgagtaccagaagaccaagctgaacgactgggacttcgtggtgaccacggacatctccgagatgggcgccaacttcaaggcggaccgcgtcatcgacccgcggcgctgcctcaagcccgtgatcctgaccgacggccccgagcgggtgatcctggccgggcccatgccggtcaccgccgccagcgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccggctgaagggcgagagccgcaagaccttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtacagcgacccgctggcgctcaaggagttcaaggacttcgccgccggccggaagtccatcgccctggacctggtgaccgagatcgggcgcgtgcccagccacctcgcccaccggacccgcaacgcgctggacaacctggtcatgctccacaccagcgagcacggcgggaaggcctaccggcacgccgtggaggagctgcccgagacgatggagaccctgctcctgctgggcctcatgatcctgctgaccgggggcgccatgctgttcctgatctccggcaaggggatcggcaagaccagcatcgggctgatctgcgtgatcgcctccagcggcatgctctggatcgcggagatcccgctgcagtggatcgcctccgccatcgtcctggagttcttcatgatggtgctcctgatccccgagcccgagaagcagcgcacgccccaggacaaccagctggcctacgtggtcatcgggatcctcaccctggccgcgatcatcgccgccaacgagatgggcctgctcgagaccaccaagcgggacctgggcatgagcaaggagccgggggtggtgtcccccacgagctacctggacgtcgacctccaccccgcctccgcgtggaccctgtacgccgtggccaccaccgtgatcacgcccatgctgcgccacaccatcgagaacagcaccgccaacgtctccctcgccgcgatcgccaaccaggccgtggtgctgatgggcctggacaaggggtggccgatcagcaagatggacctcggcgtccccctgctggccctcgggtgctactcccaggtgaaccccctgaccctgacggccgcggtgctcctgctgatcacccactacgccatcatcggccccggcctccaggccaaggccacccgggaggcccagaagcgcaccgcggccgggatcatgaagaacccgacggtcgacggcatcatgaccatcgacctggaccccgtgatctacgacagcaagttcgagaagcagctgggccaggtgatgctcctggtcctgtgcgccgtgcagctcctgctgatgcggacctcctgggccctctgcgaggcgctgaccctggccacgggccccatcaccaccctctgggagggcagccccgggaagttctggaacaccacgatcgccgtgtccatggccaacatcttccgcggcagctacctggccggggcgggcctggccttctccatcatgaagtccgtcgggaccggcaagcggggcaccgggagccagggcgagaccctcggggagaagtggaagcgcaagctgaaccagctgtcccggaaggagttcgacctctacaagaagtccggcatcaccgaggtggaccgcacggaggccaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgcgggcctgaagaaggtcaccgaggtgcgcggctacaccaagggcgggcccgggcacgaggagcccgtgcccatgagcacgtacggctggaacatcgtcaagctgatgtccgggaaggacgtgttctacctcccgcccgagaagtgcgacaccctgctgtgcgacatcggcgagagctcccccagccccaccgtggaggagtcccgcaccatccgggtcctgaagatggtggagccgtggctcaagaacaaccagttctgcatcaaggtgctgaacccctacatgcccacggtcatcgagcacctggagcgcctccagcggaagcacggcgggatgctggtgcgcaaccccctgagccggaactccacccacgagatgtactggatcagcaacggcaccgggaacatcgtggcctccgtcaacatggtgagccgcctcctgctgaaccggttcaccatgacgcaccgccggccgaccatcgagaaggacgtggacctcggcgccggcacccgccacgtcaacgccgagcccgagacccccaacatggacgtgatcggggagcggatcaagcgcatcaaggaggagcacaactccacgtggcactacgacgacgagaacccgtacaagacctgggcctaccacggcagctacgaggtgaaggcgaccgggtccgccagcagcatgatcaacggcgtcgtgaagctgctgaccaagccctgggacgtcgtgcccatggtgacgcagatggccatgaccgacaccacccccttcgggcagcagcgggtcttcaaggagaaggtggacacgcgcaccccgcggtccatgcccggcacccgccgggtgatgggcatcaccgccgagtggctctggcgcacgctggggcggaacaagaagccccgcctgtgcacccgcgaggagttcaccaagaaggtccggaccaacgcggccatgggcgccgtgttcacggaggagaaccagtgggacagcgccaaggccgcggtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgcgatgtacgccgacgacaccgccgggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatctcccgcaaggaccagcggggcagcggccaggtgggcacgtacgggctgaacaccttcaccaacatggaggcgcagctcatccgccagatggagggcgagggggtgctgtccaaggccgacctggagaacccccacctcagcgagaagaagatcacccagtggctggagacgaagggcgtcgagcggctgaagcgcatggccatctccggcgacgactgcgtggtgaagccgatcgacgaccggttcgccaacgccctcctggcgctgaacgacatggggaaggtccgcaaggacatcccccagtggcagcccagcaagggctggcacgactggcagcaggtccccttctgctcccaccacttccacgagctcatcatgaaggacgggcggaagctggtggtcccgtgccgcccccaggacgagctgatcggccgggcccgcatcagccagggggccggctggtccctccgcgagaccgcctgcctgggcaaggcgtacgcccagatgtggagcctgatgtacttccaccggcgcgacctccggctggcctccaacgccatctgcagcgccgtgcccgtgcactgggtccccaccagccgcaccacgtggtccatccacgcgcaccaccagtggatgaccaccgaggacatgctgaccgtgtggaaccgggtgtggatcgaggacaacccgtggatggaggacaagacgcccgtcaccacctgggagaacgtgccctacctcgggaagcgcgaggaccagtggtgcggcagcctgatcgggctgacctcccgggccacgtgggcccagaacatccccaccgccatccagcaggtccgcagcctcatcggcaacgaggagttcctggactacatgccgtccatgaagcggttccgcaaggaggaggagagcgagggggccatctggtga

SEQ ID NO: 10170 - RNA, 9873 nt, synthetic construct
  misc_feature 1..9873: note = derived and/or modified CDS sequence (opt1) from DENV-3__FJ182008__SS-prME
  source 1..9873: mol_type = other RNA
accagcctgtgcatcatgatgatcctccccgcggccctggcgttccacctgaccagccgggacggggagccgcggatgatcgtggggaagaacgagcgcggcaagagcctcctgttcaagaccgcctccgggatcaacatgtgcaccctgatcgccatggacctcggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctggcgccccacgtgggcatggggctcgacacccgcacccagacctggatgagcgccgagggcgcctggcgccaggtggagaaggtggagacgtgggccctgcgccacccggggttcaccatcctggccctcttcctggcccactacatcggcacctccctgacccagaaggtggtgatcttcatcctcctgatgctggtcacgcccagcatgaccatgcggtgcgtgggggtgggcaaccgcgacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcggaagctctgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctgttcgggaagggctccctcgtgacctgcgccaagttccagtgcctggagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctccccgagtacggcaccctggggctggagtgctccccgcgcaccggcctcgacttcaacgagatgatcctgctgacgatgaagaacaaggcctggatggtgcaccggcagtggttcttcgacctccccctgccctggaccagcggcgccaccaccgagacgcccacctggaaccgcaaggagctgctcgtgaccttcaagaacgcccacgccaagaagcaggaggtcgtggtgctggggtcccaggagggcgcgatgcacaccgccctgacgggggccaccgagatccagaacagcggcgggacctccatcttcgccggccacctcaagtgccggctgaagatggacaagctggagctcaagggcatgagctacgccatgtgcaccaacacgttcgtcctgaagaaggaggtgtccgagacccagcacgggaccatcctgatcaaggtggagtacaagggcgaggacgcgccgtgcaagatccccttcagcaccgaggacgggcagggcaaggcccacaacggccgcctcatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctgaacagcctcggcaagatggtccaccagatcttcgggtccgcctacacggccctgttcagcggcgtgtcctgggtgatgaagatcggcatcggggtcctgctcacctggatcggcctgaacagcaagaacacctccatgagcttctcctgcatcgccatcggggtgatcaccctgtacctcggcgccgtggtccaggcggacatggggtgcgtgatcaactggaagggcaaggagctgaagtgcggcagcgggatcttcgtgacgaacgaggtccacacctggaccgagcagtacaagttccaggccgactcccccaagcgcctggccaccgccatcgccggcgcgtgggagaacggggtgtgcggcatccgcagcacgacccggatggagaacctcctgtggaagcagatcgccaacgagctgaactacatcctctgggagaacaacatcaagctgaccgtggtcgtgggggacatcatcggcgtgctggagcagggcaagcgcaccctcacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctgaagctccgcgaggtgtacacccagctgtgcgaccaccggctgatgagcgccgccgtgaaggacgagcgcgccgtccacgcggacatgggctactggatcgagagccagaagaacgggtcctggaagctcgagaaggccagcctgatcgaggtgaagacctgcacgtggccgaagtcccacaccctgtggagcaacggcgtgctcgagtccgacatgatcatccccaagagcctggccgggcccatctcccagcacaactaccggccgggctaccacacccagaccgccgggccctggcacctgggcaagctcgagctggacttcaactactgcgagggcacgaccgtcgtgatcaccgagaactgcgggacccgcggccccagcctgcggacgaccaccgtgtccgggaagctcatccacgagtggtgctgccgcagctgcaccctgcccccgctgcggtacatgggcgaggacgggtgctggtacggcatggagatccgccccatctccgagaaggaggagaacatggtcaagagcctcgtgtccgccggcagcgggaaggtggacaacttcacgatgggcgtcctgtgcctggcgatcctcttcgaggaggtgatgcgggggaagttcggcaagaagcacatgatcgccggggtgttcttcaccttcgtcctgctgctctccggccagatcacctggcgcgacatggcccacaccctgatcatgatcggcagcaacgcctccgacaagatggggatgggcgtgacgtacctggccctcatcgcgaccttcaagatccagcccttcctggccctggggttcttcctccggaagctgaccagccgcgagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctgatcagcctgacgtgctccaacaccatgttcaccctcaccgtcgcctggcggacggcgaccctgatcctggccggggtgagcctcctgccggtctgccagtccagctccatgcgcaagaccgactggctgcccatggccgtggccgccatgggcgtgccgcccctcccgctgttcatcttcagcctgaaggacaccctcaagcggcgctcctggcccctgaacgagggggtcatggcggtgggcctggtgagcatcctcgcctccagcctgctgcgcaacgacgtccccatggccggccccctcgtggccgggggcctgctgatcgcctgctacgtgatcacggggacctccgcggacctcaccgtcgagaaggccgccgacatcacctgggaggaggaggccgagcagacgggcgtgagccacaacctgatgatcaccgtggacgacgacgggaccatgcggatcaaggacgacgagaccgagaacatcctgaccgtcctcctgaagacggccctgctcatcatctccggcgtgttcccgtacagcatccccgcgaccctgctggtgtggcacacctggcagaagcagacccagcgctccggcgtcctctgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggcctccgtcaagaaggacctgatcagctacggcgggggctggcgcctgtccgcgcagtggcagaagggggaggaggtccaggtgatcgccgtcgagcccggcaagaaccccaagaacttccagaccatgcccggcaccttccagaccacgaccggggagatcggcgccatcgccctcgacttcaagcccgggaccagcggcagccccatcatcaaccgggagggcaaggtggtggggctgtacggcaacggggtcgtgaccaagaacggcgggtacgtgtccggcatcgcccagacgaacgcggagccggacggccccacccccgagctggaggaggagatgttcaagaagcgcaacctgaccatcatggacctccaccccgggagcggcaagacccggaagtacctgccggccatcgtccgcgaggccatcaagcggcgcctgcggacgctcatcctggcccccacccgcgtggtggccgcggagatggaggaggccctgaaggggctccccatccggtaccagaccaccgccacgaagtccgagcacaccggccgcgagatcgtcgacctgatgtgccacgccaccttcaccatgcggctgctcagccccgtgcgcgtgccgaactacaacctgatcatcatggacgaggcccacttcacggaccccgcgtccatcgccgcccgggggtacatcagcacccgcgtcggcatgggcgaggccgcggccatcttcatgaccgccacgccgcccgggacggccgacgccttcccgcagtccaacgcgcccatccaggacgaggagcgggacatccccgagcgcagctggaactccggcaacgagtggatcaccgacttcgccgggaagaccgtgtggttcgtgcccagcatcaaggccggcaacgacatcgccaactgcctgcgcaagaacgggaagaaggtcatccagctctcccggaagaccttcgacacggagtaccagaagaccaagctgaacgactgggacttcgtggtgaccaccgacatcagcgagatgggcgccaacttcaaggcggaccgcgtcatcgacccgcggcgctgcctgaagcccgtgatcctcacggacggccccgagcgggtgatcctggccgggcccatgccggtcaccgccgcctccgccgcgcagcgccggggccgcgtggggcggaacccccagaaggagaacgaccagtacatcttcaccggccagcccctgaacaacgacgaggaccacgcccactggaccgaggccaagatgctcctggacaacatcaacacccccgaggggatcatcccggccctgttcgagcccgagcgcgagaagtccgcggccatcgacggcgagtaccggctcaagggcgagtcccgcaagacgttcgtggagctgatgcggcgcggggacctgcccgtctggctcgcccacaaggtggccagcgagggcatcaagtacaccgaccggaagtggtgcttcgacgggcagcgcaacaaccagatcctggaggagaacatggacgtcgagatctggaccaaggagggcgagaagaagaagctgcggccccgctggctcgacgcccggacctactccgacccgctggcgctgaaggagttcaaggacttcgccgccggccgcaagagcatcgccctcgacctggtgacggagatcgggcgcgtgccctcccacctggcccaccggacccgcaacgcgctcgacaacctggtcatgctgcacaccagcgagcacggcgggcgggcctaccgccacgccgtggaggagctccccgagaccatggagacgctgctgctcctgggcctgatgatcctcctgaccgggggcgccatgctgttcctcatcagcggcaaggggatcggcaagacctccatcgggctgatctgcgtgatcgccagctccggcatgctgtggatggcggagatcccgctccagtggatcgccagcgccatcgtcctggagttcttcatgatggtgctgctcatccccgagcccgagaagcagcggacgccccaggacaaccagctggcctacgtggtcatcgggatcctgacgctcgccgcgatcatcgccgccaacgagatgggcctgctggagaccaccaagcgcgacctcggcatgtccaaggagccgggggtggtgagccccacctcctacctggacgtcgacctgcaccccgccagcgcgtggacgctctacgccgtggccaccaccgtgatcacccccatgctgcggcacacgatcgagaactccaccgccaacgtcagcctggccgcgatcgccaaccaggccgtggtgctcatgggcctggacaaggggtggccgatctccaagatggacctgggcgtccccctcctggccctggggtgctacagccaggtgaaccccctcaccctgaccgccgcggtgctgctcctgatcacgcactacgccatcatcggccccggcctgcaggccaaggccacccgcgaggcccagaagcggaccgcggccgggatcatgaagaacccgaccgtcgacggcatcatgacgatcgacctcgaccccgtgatctacgactccaagttcgagaagcagctgggccaggtgatgctgctcgtcctgtgcgccgtgcagctgctcctgatgcgcaccagctgggccctgtgcgaggcgctcaccctggccaccggccccatcacgaccctgtgggagggctcccccgggaagttctggaacaccaccatcgccgtgagcatggccaacatcttccggggctcctacctcgccggggcgggcctggccttcagcatcatgaagtccgtcgggacgggcaagcgcggcaccgggagccagggcgagaccctgggggagaagtggaagaagaagctcaaccagctgagccggaaggagttcgacctgtacaagaagtccggcatcaccgaggtggaccgcaccgaggccaaggaggggctcaagcggggcgagacgacccaccacgccgtgagccgcggcaccgccaagctgcagtggttcgtcgagcggaacatggtgatcccggaggggcgcgtgatcgacctgggctgcgggcggggcgggtggtcctactactgcgcgggcctcaagaaggtcaccgaggtgcgcggctacacgaagggcgggcccgggcacgaggagcccgtgcccatgagcacctacggctggaacatcgtcaagctgatgtccgggaaggacgtgttctacctgccgcccgagaagtgcgacaccctcctgtgcgacatcggcgagagctcccccagccccaccgtggaggagtcccggacgatccgcgtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgagccggaactccacccacgagatgtactggatcagcaacggcaccgggaacatcgtggcctccgtcaacatggtgagccgcctgctcctgaaccggttcacgatgacccaccgccggccgaccatcgagaaggacgtggacctgggcgccggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggcgaccgggtccgccagctccatgatcaacggcgtcgtgaagctcctgacgaagccctgggacgtcgtgcccatggtgacccagatggccatgaccgacaccacgcccttcgggcagcagcgggtcttcaaggagaaggtggacacccgcaccccgcggagcatgcccggcacccgccgggtgatgggcatcacggccgagtggctgtggcgcaccctcgggcggaacaagaagccccgcctgtgcacccgggaggagttcaccaagaaggtccgcacgaacgcggccatgggcgccgtgttcaccgaggagaaccagtgggacagcgccaaggccgcggtggaggacgaggacttctggaagctggtcgaccgcgagcgggagctccacaagctggggaagtgcggctcctgcgtgtacaacatgatggggaagcgcgagaagaagctgggcgagttcggcaaggccaaggggagccgggccatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccgggggcgcgatgtacgccgacgacaccgccgggtgggacacccggatcacggaggacgacctgcacaacgaggagaagatcacccagcagatggacccggagcaccgccagctggccaacgccatcttcaagctcacctaccagaacaaggtcgtgaaggtgcagcggcccacccccaccggcacggtcatggacatcatctcccgcaaggaccagcggggcagcggccaggtgggcacctacgggctgaacaccttcaccaacatggaggcgcagctgatccgccagatggagggcgagggggtgctctccaaggccgacctggagaacccccacctccccgagaagaagatcacgcagtggctggagaccaagggcgtcgagcggctgcgccggatggccatcagcggcgacgactgcgtggtgaagcccatcgacgaccgcttcgccaacgccctgctcgcgctgaacgacatggggaaggtccggaaggacatcccccagtggcagccctccaagggctggcacgactggcagcaggtcccgttctgcagccaccacttccacgagctgatcatgaaggacgggcgcaagctcgtggtcccctgccggccccaggacgagctgatcggccgcgcccggatctcccagggggccggctggagcctgcgcgagaccgcctgcctcggcaaggcgtacgcccagatgtggtccctgatgtacttccaccgccgggacctgcgcctcgccagcaacgccatctgctccgccgtgcccgtgcactgggtcccgaccagccggacgacctggtccatccacgcgcaccaccagtggatgaccaccgaggacatgctgacggtgtggaaccgcgtgtggatcgaggacaacccctggatggaggacaagacccccgtcaccacctgggagaacgtgccctacctggggaagcgggaggaccagtggtgcggcagcctcatcgggctgacgagccgcgccacctgggcccagaacatcccgaccgccatccagcaggtccggtccctgatcggcaacgaggagttcctcgactacatgcccagcatgaagcgcttccggaaggaggaggagtccgagggggccatctggtga

SEQ ID NO: 10171 - RNA, 9873 nt, synthetic construct
  misc_feature 1..9873: note = derived and/or modified CDS sequence (opt1) from DENV-3__FJ182010__SS-prME
  source 1..9873: mol_type = other RNA
accagcctgtgcctcatgatgatcctgcccgccgccctggccttccacctcaccagccgcgacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcggcaggtcgagaaggtcgagacctgggcgctgcgccacccggggttcacgatcctcgccctgttcctggcccactacatcggcacctccctcacccagaaggtggtgatcttcgtcctgctgatgctcgtgacccccagcatgacgatgcggtgcgtgggggtcggcaaccgcgacttcgtggagggcctgtccggggccacctgggtggacgtcgtgctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtcctgccggaggagcaggaccagaactacgtgtgcaagcacacgtacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcaccgtgcacacgggggaccagcaccaggtcggcaacgagacccagggggtgaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtcaccttcaagaacgcccacgcgaagaagcaggaggtggtggtcctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtgctgaagaaggaggtgtccgagacgcagcacgggaccatcctcatcaaggtcgagtacaagggcgaggacgccccgtgcaagatccccttcagcaccgaggacgggcagggcaaggcccacaacggccgcctgatcaccgccaaccccgtggtgacgaagaaggaggagcccgtcaacatcgaggcggagccgcccttcggggagagcaacatcgtgatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgcggtggtccaggccgacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgcgggcgcctgggagaacggggtgtgcggcatccgcagcacgacccggatggagaacctgctgtggaagcaggtcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgcggtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgcgggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgcgctgatcgccaccttcaagatccagcccttcctggccctcgggttcttcctgcgcaagctgaccagccgggagaacctcctgctgggcgtcggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtggcgtggcgcacggccaccctgatcctcgccggggtcagcctgctgccggtgtgccagtccagctccatgcggaagtccgactggctccccatgaccgtggccgccatgggcgtgccgcccctcccgctgttcatcttctccctcaaggacaccctgaagcgccgcagctggcccctgaacgagggggtgatggcggtgggcctcgtctccatcctggccagctccctgctccggaacgacgtgcccatggccggccccctggtggccgggggcctgctcatcgcctgctacgtcatcacggggaccagcgcggacctgaccgtggagaaggccgccgacgtgacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcatcttcccgtactccatccccgcgaccctgctcgtgtggcacacctggcagaagcagacccggcgcagcggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgtacaacgggaagcggctggagcccaactgggccagcgtgaagaaggacctgatctcctacggcgggggctggcgcctcagcgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggctcccccatcatcaaccgggagggcaaggtcgtggggctgtacggcaacggggtggtcaccaagaacggcgggtacgtgagcggcatcgcccagacgaacgcggagccggacggccccacccccgagctggaggaggagatgttcaagaagcgcaacctcaccatcatggacctgcaccccgggtccggcaagacccggaagtacctgccggccatcgtgcgcgaggccatcaagcggcgcctccggacgctgatcctggcccccacccgcgtcgtggccgcggagatggaggaggccctcaaggggctgcccatccggtaccagaccaccgccaccaagagcgagcacaccggccgcgagatcgtggacctgatgtgccacgccaccttcaccatgcggctcctgtcccccgtccgcgtgccgaactacaacctgatcatcatggacgaggcccacttcacggaccccgcgagcatcgccgcccgggggtacatctccacccgcgtgggcatgggcgaggccgcggccatcttcatgaccgccacgccgcccgggacggccgacgccttcccgcagagcaacgcgcccatccaggacgaggagcgcgacatccccgagcggtcctggaacagcggcaacgagtggatcaccgacttcgccgggaagaccgtctggttcgtgccctccatcaaggccggcaacgacatcgccaactgcctccgcaagaacgggaagaaggtgatccagctgagccggaagaccttcgacacggagtaccagaagaccaagctgaacgactgggacttcgtcgtgaccaccgacatctccgagatgggcgccaacttcaaggcggaccgcgtgatcgacccgcggcgctgcctcaagcccgtcatcctgacggacggccccgagcgggtgatcctggccgggcccatgccggtgaccgccgccagcgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctacagcgacccgctggcgctcaaggagttcaaggacttcgccgccggccggaagtccatcgccctggacctggtcacggagatcgggcgcgtgcccagccacctcgcccaccggacccgcaacgcgctggacaacctggtgatgctccacaccagcgagcacggcgggaaggcctaccggcacgccgtcgaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggcggagatcccgctgcagtggatcgcctccgccatcgtgctggagttcttcatgatggtcctcctgatccccgagcccgagaagcagcgcacgccccaggacaaccagctggcctacgtggtgatcgggatcctcacgctggccgcgatcatcgccgccaacgagatgggcctgctcgagaccaccaagcgggacctgggcatgagcaaggagccgggggtcgtgtcccccaccagctacctggacgtggacctccaccccgcctccgcgtggacgctgtacgccgtcgccaccaccgtgatcacccccatgctgcgccacacgatcgagaacagcaccgccaacgtgtccctcgccgcgatcgccaaccaggccgtcgtgctgatgggcctggacaaggggtggccgatcagcaagatggacctcggcgtgcccctgctggccctcgggtgctactcccaggtcaaccccctgaccctgaccgccgcggtgctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtcatctacgacagcaagttcgagaagcagctgggccaggtgatgctcctggtgctgtgcgccgtccagctcctgctgatgcggacctcctgggccctctgcgaggcgctgaccctggccaccggccccatcacgaccctctgggagggcagccccgggaagttctggaacaccaccatcgccgtgtccatggccaacatcttccgcggcagctacctggccggggcgggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtcgaccggaccgaggccaaggaggggctgaagcgcggcgagatcacgcaccacgccgtgtcccggggcagcgccaagctgcagtggttcgtggagcgcaacatggtcatcccggaggggcgggtgatcgacctcggctgcgggcgcggcgggtggtcctactactgcgcgggcctgaagaaggtgaccgaggtccggggctacaccaagggcgggcccgggcacgaggagcccgtgcccatgagcacctacggctggaacatcgtgaagctgatgtccgggaaggacgtcttctacctcccgcccgagaagtgcgacacgctgctgtgcgacatcggcgagagctcccccagccccaccgtggaggagtcccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacgcacgagatgtactggatcagcaacggcaccgggaacatcgtggcctccgtgaacatggtcagccggctcctgctgaaccgcttcaccatgacccaccggcgcccgacgatcgagaaggacgtggacctcggcgccggcacccggcacgtgaacgccgagcccgagacccccaacatggacgtcatcggggagcgcatcaagcggatcaaggaggagcacaactccacctggcactacgacgacgagaacccgtacaagacgtgggcctaccacggcagctacgaggtgaaggcgaccgggtccgccagcagcatgatcaacggcgtcgtgaagctgctgaccaagccctgggacgtggtccccatggtgacccagatggccatgacggacaccacccccttcgggcagcagcgcgtgttcaaggagaaggtcgacacccggacgccgcgctccatgcccggcacccggcgcgtgatgggcatcaccgccgagtggctctggcggaccctggggcgcaacaagaagccccggctgtgcacgcgcgaggagttcaccaagaaggtgcgcaccaacgcggccatgggcgccgtcttcaccgaggagaaccagtgggacagcgccaaggccgcggtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgcgatgtacgccgacgacacggccgggtgggacacccgcatcaccgaggacgacctgcacaacgaggagaagatcacccagcagatggacccggagcaccggcagctcgccgacgccatcttcaagctgacgtaccagaacaaggtggtcaaggtgcagcgccccacccccaccggcaccgtgatggacatcatctcccggaaggaccagcgcggcagcgggcaggtcggcacctacgggctgaacacgttcaccaacatggaggcgcagctcatccggcagatggagggcgagggggtgctgaccaaggccgacctggagaacccccacctctccgagaagaagatcacccagtggctggagacgaagggcgtggagcgcctgaagcggatggccatcagcggcgacgactgcgtcgtgaagccgatcgacgaccgcttcgccaacgccctcctggcgctgaacgacatggggaaggtgcggaaggacatcccccagtggcagccctccaagggctggcacgactggcagcaggtccccttctgcagccaccacttccacgagctcatcatgaaggacgggcgcaagctggtggtgccgtgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtccccgtgcactgggtgcccaccagccggaccacgtggagcatccacgcgcaccaccagtggatgaccaccgaggacatgctgaccgtctggaaccgcgtgtggatcgaggacaacccgtggatggaggacaagacgcccgtgaccacctgggagaacgtcccctacctcgggaagcgggaggaccagtggtgcggctccctgatcgggctgaccagccgcgccacgtgggcccagaacatccccaccgccatccagcaggtccggtccctcatcggcaacgaggagttcctggactacatgccgagcatgaagcgcttccggaaggaggaggagtccgagggggccatctggtga

SEQ ID NO: 10172 - RNA, 9873 nt, synthetic construct
  misc_feature 1..9873: note = derived and/or modified CDS sequence (opt1) from DENV-3__FJ182011__SS-prME
  source 1..9873: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtggagacctgggcgctgcgccacccggggttcacgatcctcgccctgttcctggcccactacatcggcacctccctcacccagaaggtggtgatcttcatcctgctgatgctcgtgacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgcggtggtgcaggccgacaccgggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgcgggcgcctgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgcggtgcacgccgacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgacaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgcgggcagcgggaaggtggacaacttcacgatgggcgtgctgtgcctcgccatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgcgctgatcgccaccttcaagatccagcccttcctggccctcgggttcttcctgcgcaagctgaccagccgggagaacctcctgctgggcgtgggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtggcgtggcgcacggccaccctgatcctcgccggggtcagcctgctgccggtgtgccagtccagctccatgcggaagtccgactggctccccatgaccgtcgccgccatgggcgtgccgcccctcccgctgttcatcttctccctcaaggacaccctgaagcgccgcagctggcccctgaacgagggggtgatggcggtcggcctcgtgtccatcctggccagctccctgctccggaacgacgtgcccatggccggccccctggtcgccgggggcctgctcatcgcctgctacgtgatcacggggaccagcgcggacctgaccgtggagaaggccgccgacgtcacctgggaggaggaggccgagcagacgggcgtgtcccacaacctgatgatcaccgtggacgacgacgggaccatgcgcatcaaggacgacgagaccgagaacatcctcaccgtcctgctgaagacggccctcctgatcgtgagcggcatcttcccgtactccatccccgcgaccctgctcgtgtggcacacctggcagaagcagacccggcgcagcggcgtcctgtgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctcacgtacaacgggaagcggctggagcccaactgggccagcgtcaagaaggacctgatctcctacggcgggggctggcgcctcagcgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggctcccccatcatcaaccgggagggcaaggtggtggggctgtacggcaacggggtcgtgaccaagaacggcgggtacgtgagcggcatcgcccagacgaacgcggagccggacggccccacccccgagctggaggaggagatgttcaagaagcgcaacctcaccatcatggacctgcaccccgggtccggcaagacccggaagtacctgccggccatcgtccgcgaggccatcaagcggcgcctccggacgctgatcctggcccccacccgcgtggtggccgcggagatggaggaggccctcaaggggctgcccatccggtaccagaccaccgccaccaagagcgagcacaccggccgcgagatcgtcgacctgatgtgccacgccaccttcaccatgcggctcctgtcccccgtgcgcgtgccgaactacaacctgatcatcatggacgaggcccacttcacggaccccgcgagcatcgccgcccgggggtacatctccacccgcgtcggcatgggcgaggccgcggccatcttcatgaccgccacgccgcccgggacggccgacgccttcccgcagagcaacgcgcccatccaggacgaggagcgcgacatccccgagcggtcctggaacagcggcaacgagtggatcaccgacttcgccgggaagaccgtgtggttcgtgccctccatcaaggccggcaacgacatcgccaactgcctccgcaagaacgggaagaaggtcatccagctgagccggaagaccttcgacacggagtaccagaagaccaagctgaacgactgggacttcgtggtgaccaccgacatctccgagatgggcgccaacttcaaggcggaccgcgtcatcgacccgcggcgctgcctcaagcccgtgatcctgacggacggccccgagcgggtgatcctggccgggcccatgccggtcaccgccgccagcgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacctacagcgacccgctggcgctcaaggagttcaaggacttcgccgccggccggaagtccatcgccctggacctggtgacggagatcgggcgcgtgcccagccacctcgcccaccggacccgcaacgcgctggacaacctggtcatgctccacaccagcgagcacggcgggaaggcctaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggcggagatcccgctgcagtggatcgcctccgccatcgtcctggagttcttcatgatggtgctcctgatccccgagcccgagaagcagcgcacgccccaggacaaccagctggcctacgtggtcatcgggatcctcacgctggccgcgatcatcgccgccaacgagatgggcctgctcgagaccaccaagcgggacctgggcatgagcaaggagccgggggtggtgtcccccaccagctacctggacgtcgacctccaccccgcctccgcgtggacgctgtacgccgtggccaccaccgtgatcacccccatgctgcgccacacgatcgagaacagcaccgccaacgtctccctcgccgcgatcgccaaccaggccgtggtgctgatgggcctggacaaggggtggccgatcagcaagatggacctcggcgtccccctgctggccctcgggtgctactcccaggtgaaccccctgaccctgaccgccgcggtgctcctgctgatcacgcactacgccatcatcggccccggcctccaggccaaggccacccgggaggcccagaagcgcaccgcggccgggatcatgaagaacccgaccgtcgacggcatcatgacgatcgacctggaccccgtgatctacgacagcaagttcgagaagcagctgggccaggtgatgctcctggtcctgtgcgccgtgcagctcctgctgatgcggacctcctgggccctctgcgaggcgctgaccctggccaccggccccatcacgaccctctgggagggcagccccgggaagttctggaacaccaccatcgccgtgtccatggccaacatcttccgcggcagctacctggccggggcgggcctggccttctccatcatgaagtccgtcgggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgccgtgtcccggggcagcgccaagctgcagtggttcgtcgagcgcaacatggtgatcccggaggggcgggtgatcgacctcggctgcgggcgcggcgggtggtcctactactgcgcgggcctgaagaaggtcaccgaggtgcggggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacgcacgagatgtactggatcagcaacggcaccgggaacatcgtggcctccgtcaacatggtgagccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtgaaggcgaccgggtccgccagcagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgctccatgcccggcacccggcgcgtgatgggcatcaccgccgagtggctctggcggaccctggggcgcaacaagaagccccggctgtgcacgcgcgaggagttcaccaagaaggtccgcaccaacgcggccatgggcgccgtgttcaccgaggagaaccagtgggacagcgccaaggccgcggtggaggacgaggacttctggaagctcgtcgaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgcgatgtacgccgacgacacggccgggtgggacacccgcatcaccgaggacgacctgcacaacgaggagaagatcacccaccagatggacccggagcaccggcagctcgccaacgccatcttcaagctgacgtaccagaacaaggtcgtgaaggtgcagcgccccacccccaccggcaccgtcatggacatcatctcccggaaggaccagcgcggcagcggccaggtgggcacctacgggctgaacacgttcaccaacatggaggcgcagctcatccggcagatggagggcgagggggtgctgtccaaggccgacctggagaacccccacctcagcgagaagaagatcacccagtggctggagaccaagggcgtcgagcgcctgaagcggatggccatctccggcgacgactgcgtggtgaagccgatcgacgaccgcttcgccaacgccctcctggcgctgaacgacatggggaaggtccggaaggacatcccccagtggcagcccagcaagggctggcacgactggcagcaggtccccttctgctcccaccacttccacgagctcatcatgaaggacgggcgcaagctggtggtcccgtgccggccccaggacgagctgatcggccgcgcccggatcagccagggggccggctggtccctccgcgagacggcctgcctgggcaaggcgtacgcccagatgtggagcctgatgtacttccaccgccgggacctccgcctggcctccaacgccatctgcagcgccgtgcccgtgcactgggtccccaccagccggaccacctggtccatccacgcgcaccaccagtggatgacgaccgaggacatgctgaccgtgtggaaccgcgtgtggatcgaggacaacccgtggatggaggacaagacccccgtcacgacctgggagaacgtgccctacctcgggaagcgggaggaccagtggtgcggcagcctgatcgggctgacctcccgcgccacctgggcccagaacatccccacggccatccagcaggtccggagcctcatcggcaacgaggagttcctggactacatgccgtccatgaagcgcttccggaaggaggaggagagcgagggggccatctggtga

SEQ ID NO: 10173 - RNA, 9873 nt, synthetic construct
  misc_feature 1..9873: note = derived and/or modified CDS sequence (opt1) from DENV-3__FJ182038__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacgaccctgttcagcggcgtgtcctgggtgatgaagatcggcatcggggtcctcctgacctggatcggcctgaacagcaagaacacctccatgagcttctcctgcatcgccatcggggtgatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgacaagatggggatgggcgtgacctacctcgccctgatcgccaccttcaagatccagcccttcctggcgctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatgttcaccctgacggtcgcctggcggaccgccaccctgatcctcgcgggggtgagcctgctgccggtctgccagtccagctccatgcgcaagaccgactggctccccatggccgtggccgccatgggcgtgccgcccctcccgctgttcatcttcagcctcaaggacacgctgaagcggcgctcctggcccctgaacgagggggtcatggccgtgggcctcgtgagcatcctggcgtccagcctgctccgcaacgacgtccccatggccggccccctggtggccgggggcctgctcatcgcctgctacgtgatcaccgggacctccgccgacctgaccgtcgagaaggcggccgacatcacgtgggaggaggaggccgagcagaccggcgtgagccacaacctgatgatcaccgtggacgacgacgggaccatgcggatcaaggacgacgagaccgagaacatcctcacggtcctgctgaagaccgccctcctgatcgtgtccggcgtgttcccgtacagcatccccgccaccctgctcgtctggcacacctggcagaagcagacgcagcgctccggcgtgctgtgggacgtgcccagcccgcccgagacccagaaggcggagctggaggagggggtctaccggatcaagcagcagggcatcttcgggaagacccaggtgggcgtgggggtccagaaggagggcgtgttccacaccatgtggcacgtgacgcgcggcgccgtcctcacctacaacgggaagcggctggagcccaactgggcctccgtgaagaaggacctgatcagctacggcgggggctggcgcctctccgcccagtggcagaagggggaggaggtgcaggtcatcgcggtggagcccggcaagaaccccaagaacttccagaccatgcccggcaccttccagacgaccaccggggagatcggcgccatcgccctggacttcaagcccgggaccagcggcagccccatcatcaaccgggagggcaaggtggtcgggctgtacggcaacggggtggtgacgaagaacggcgggtacgtctccggcatcgcccagaccaacgccgagccggacggccccacccccgagctggaggaggagatgttcaagaagcgcaacctcaccatcatggacctgcaccccgggagcggcaagacgcggaagtacctgccggcgatcgtgcgcgaggccatcaagcggcgcctccggaccctgatcctggcccccacccgcgtggtcgccgccgagatggaggaggcgctcaaggggctgcccatccggtaccagaccacggccaccaagtccgagcacaccggccgcgagatcgtggacctgatgtgccacgccaccttcacgatgcggctcctgagccccgtgcgcgtcccgaactacaacctgatcatcatggacgaggcccacttcaccgaccccgcctccatcgcggcccgggggtacatcagcacccgcgtgggcatgggcgaggccgccgcgatcttcatgaccgccacgccgcccgggaccgccgacgccttcccgcagtccaacgcccccatccaggacgaggagcgggacatccccgagcgcagctggaactccggcaacgagtggatcaccgacttcgcggggaagaccgtgtggttcgtccccagcatcaaggccggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggccgaccgcgtgatcgacccgcggcgctgcctcaagcccgtgatcctgaccgacggccccgagcgggtcatcctggcggggcccatgccggtgaccgccgcctccgccgcccagcgccggggccgcgtggggcggaacccccagaaggagaacgaccagtacatcttcatgggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagtcccgcaagacgttcgtcgagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccggacctactccgacccgctggccctcaaggagttcaaggacttcgcggccggccgcaagagcatcgccctggacctggtgacggagatcgggcgcgtcccctcccacctcgcccaccggacccgcaacgccctggacaacctggtgatgctccacaccagcgagcacggcgggcgggcgtaccgccacgccgtggaggagctgcccgagaccatggagacgctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgcgagcgccatcgtgctggagttcttcatgatggtgctcctgatccccgagcccgagaagcagcggacgccccaggacaaccagctggcctacgtcgtgatcgggatcctcacgctggccgccaccatcgcggccaacgagatgggcctgctcgagaccaccaagcgcgacctgggcatgtccaaggagccgggggtggtcagccccacgtcctacctggacgtggacctccaccccgccagcgcctggaccctgtacgcggtggccaccaccgtcatcacgcccatgctgcggcacaccatcgagaactccaccgccaacgtgagcctcgccgccatcgcgaaccaggccgtggtcctgatgggcctggacaaggggtggccgatctccaagatggacctcggcgtgcccctgctggccctcgggtgctacagccaggtgaaccccctgaccctgacggccgccgtcctcctgctgatcacccactacgcgatcatcggccccggcctccaggccaaggccacccgcgaggcccagaagcggaccgccgcggggatcatgaagaacccgacggtggacggcatcatgaccatcgacctggaccccgtgatctacgactccaagttcgagaagcagctggggcaggtcatgctcctggtgctgtgcgccgtgcagctcctgctgatgcgcaccagctgggccctctgcgaggccctgaccctggcgacgggccccatcaccaccctctgggagggctcccccgggaagttctggaacaccacgatcgccgtcagcatggccaacatcttccggggctcctacctggccggggccggcctggcgttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggccaaggaggggctgaagcggggcgagaccacccaccacgccgtcagccgcggcaccgccaagctgcagtggttcgtggagcggaacatggtgatcccggaggggcgcgtcatcgacctcggctgcgggcggggcgggtggtcctactactgcgccggcctgaagaaggtgacggaggtgcgcggctacaccaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccacggtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcacggggaacatcgtcgcgtccgtgaacatggtgagccgcctcctgctgaaccggttcaccatgacccaccgccggccgaccatcgagaaggacgtcgacctcggcgccggcacgcgccacgtgaacgccgagcccgagacccccaacatggacgtgatcggggagcggatcaagcgcatcaaggaggagcacaactccacctggcactacgacgacgagaacccgtacaagacctgggcctaccacggcagctacgaggtcaaggccacggggtccgcgagctccatgatcaacggcgtggtcaagctgctgaccaagccctgggacgtggtgcccatggtcacccagatggccatgaccgacacgacccccttcgggcagcagcgggtgttcaaggagaaggtggacacccgcaccccgcggagcatgcccggcacgcgccgggtcatgggcatcaccgccgagtggctctggcgcaccctggggcggaacaagaagccccgcctgtgcacccgggaggagttcacgaagaaggtgcgcaccaacgccgcgatgggcgccgtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgcggacgacaccgccgggtgggacacgcggatcaccgaggacgacctgcacaacgaggagaagatcacccagcagatggacccggagcaccgccagctcgccaacgccatcttcaagctgacctaccagaacaaggtggtgaaggtccagcggcccacccccacgggcaccgtgatggacatcatctcccgcaaggaccagcggggcagcggccaggtgggcacctacgggctgaacaccttcacgaacatggaggcccagctcatccgccagatggagggcgagggggtcctgtccaaggcggacctggagaacccccacctcccggagaagaagatcacccagtggctggagaccaagggcgtggagcggctgcgccggatggccatcagcggcgacgactgcgtggtcaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcgcggatctcccagggggccggctggagcctccgcgagaccgcctgcctgggcaaggcctacgcgcagatgtggtccctgatgtacttccaccgccgggacctccgcctggccagcaacgccatctgctccgccgtgcccgtccactgggtgccgacgagccggaccacctggtccatccacgcccaccaccagtggatgaccacggaggacatgctgaccgtgtggaaccgcgtctggatcgaggacaacccctggatggaggacaagacccccgtgaccacgtgggagaacgtgccctacctcgggaagcgggaggaccagtggtgcggcagcctgatcgggctgaccagccgcgcgacctgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10174 - RNA, 9873 nt, synthetic construct
  misc_feature 1..9873: note = derived and/or modified CDS sequence (opt1) from DENV-3__FJ182041__SS-prME
  source 1..9873: mol_type = other RNA
accagcctgtgcctcatgatgatcctgcccgccgccctggccttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtcgcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgcgatcctgttcgaggaggtgatgcgggggaagttcggcaagaagcacatgatcgccggggtgttcttcaccttcgtcctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtcgcctggcgcacggcgaccctgatcctcgccggggtgagcctgctgccggtctgccagtccagctccatgcggaagtccgactggctccccatgaccgtggccgccatgggcgtgccgcccctcccgctgttcatcttctccctcaaggacaccctgaagcgccgcagctggcccctgaacgagggggtcatggccgtgggcctcgtgtccatcctggcgagctccctgctccggaacgacgtccccatggccggccccctggtggccgggggcctgctcatcgcctgctacgtgatcacggggaccagcgccgacctgaccgtcgagaaggcggccgacgtgacctgggaggaggaggccgagcagacgggcgtgtcccacaacctgatgatcaccgtcgacgacgacgggaccatgcgcatcaaggacgacgagaccgagaacatcctcaccgtgctgctgaagacggccctcctgatcgtgagcggcatcttcccgtactccatccccgccaccctgctcgtctggcacacctggcagaagcagacccagcggagcggcgtgctgtgggacgtgcccagcccgcccgagacgcagaaggcggagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggccagcgtgaagaaggacctgatctcctacggcgggggctggcggctcagcgcccagtggcagaagggggaggaggtgcaggtcatcgcggtggagcccggcaagaaccccaagaacttccagaccatgcccggcaccttccagaccacgaccggggagatcggcgccatcgccctggacttcaagcccgggaccagcggctcccccatcatcaaccgcgagggcaaggtggtcgggctgtacggcaacggggtggtgaccaagaacggcgggtacgtcagcggcatcgcccagacgaacgccgagccggacggccccacccccgagctggaggaggagatgttcaagaagcggaacctcaccatcatggacctgcaccccgggtccggcaagacccgcaagtacctgccggcgatcgtgcgggaggccatcaagcgccggctccgcacgctgatcctggcccccacccgggtggtcgccgccgagatggaggaggcgctcaaggggctgcccatccgctaccagaccaccgccaccaagagcgagcacaccggccgggagatcgtggacctgatgtgccacgccaccttcaccatgcgcctcctgtcccccgtgcgggtcccgaactacaacctgatcatcatggacgaggcccacttcacggaccccgccagcatcgcggcccgcgggtacatctccacccgggtgggcatgggcgaggccgccgcgatcttcatgaccgccacgccgcccgggacggccgacgccttcccgcagagcaacgcccccatccaggacgaggagcgcgacatccccgagcgctcctggaacagcggcaacgagtggatcaccgacttcgcggggaagaccgtgtggttcgtcccctccatcaaggccggcaacgacatcgccaactgcctccggaagaacgggaagaaggtgatccagctgagccgcaagaccttcgacacggagtaccagaagaccaagctgaacgactgggacttcgtggtcaccaccgacatctccgagatgggcgccaacttcaaggccgaccgggtgatcgacccgcgccggtgcctcaagcccgtgatcctgacggacggccccgagcgcgtcatcctggcggggcccatgccggtgaccgccgccagcgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagagccggaagacgttcgtcgagctgatgcgccgcggggacctccccgtgtggctggcccacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggccctcaaggagttcaaggacttcgcggccggccgcaagtccatcgccctggacctggtgacggagatcgggcgggtccccagccacctcgcccaccgcacccggaacgccctggacaacctggtgatgctccacaccagcgagcacggcgggaaggcgtaccgccacgccgtggaggagctgcccgagaccatggagacgctgctcctgctgggcctcatgatcctgctgaccgggggcgccatgctgttcctgatctccggcaaggggatcggcaagaccagcatcgggctgatctgcgtcatcgcctccagcggcatgctctggatggccgagatcccgctgcagtggatcgcgtccgccatcgtgctggagttcttcatgatggtgctcctgatccccgagcccgagaagcagcggacgccccaggacaaccagctggcctacgtcgtgatcgggatcctcacgctggccgccatcatcgcggccaacgagatgggcctgctcgagaccaccaagcgcgacctgggcatgagcaaggagccgggggtggtctcccccaccagctacctggacgtggacctccaccccgcctccgcctggacgctgtacgcggtggccaccaccgtcatcacccccatgctgcggcacacgatcgagaacagcaccgccaacgtgtccctcgccgccatcgcgaaccaggccgtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgcgatcatcggccccggcctccaggccaaggccacccgcgaggcccagaagcggaccgccgcggggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcgcacctcctgggccctctgcgaggccctgaccctggcgaccggccccatcacgaccctctgggagggcagccccgggaagttctggaacaccaccatcgccgtctccatggccaacatcttccggggcagctacctggccggggccggcctggcgttctccatcatgaagtccgtggggacgggcaagcgcggcaccgggacccagggcgagaccctcggggagaagtggaagaagaagctgaaccagctgagccggaaggagttcgacctctacaagaagtccggcatcaccgaggtggaccgcacggaggccaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgcgagcgtgaacatggtgtcccgcctcctgctgaaccggttcaccatgacgcaccgccggccgaccatcgagaaggacgtcgacctcggcgccggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcgtccagcatgatcaacggcgtggtcaagctgctgaccaagccctgggacgtggtgcccatggtcacgcagatggccatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgcgatgggcgccgtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgcggacgacaccgccgggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggcggacctggagaacccccacctctccgagaagaagatcacccagtggctggagacgaagggcgtggagcggctgaagcgcatggccatcagcggcgacgactgcgtggtcaagccgatcgacgaccggttcgccaacgccctcctggccctgaacgacatggggaaggtgcgcaaggacatcccccagtggcagccctccaagggctggcacgactggcagcaggtccccttctgcagccaccacttccacgagctcatcatgaaggacgggcggaagctggtcgtgccgtgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtgcccgtccactgggtgcccaccagccgcaccacgtggagcatccacgcccaccaccagtggatgaccaccgaggacatgctgaccgtgtggaaccgggtctggatcgaggacaacccgtggatggaggacaagacgcccgtgaccacctgggagaacgtgccctacctcgggaagcgcgaggaccagtggtgcggctccctgatcgggctgaccagccgggcgacgtgggcccagaacatccccaccgccatccagcaggtccgctccctcatcggcaacgaggagttcctggactacatgccgagcatgaagcggttccgcaaggaggaggagtccgagggggccatctggtga

SEQ ID NO: 10175 - RNA, 9873 nt, synthetic construct
  misc_feature 1..9873: note = derived and/or modified CDS sequence (opt1) from DENV-3__FJ390371__SS-prME
  source 1..9873: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtggagacctgggcgctgcgccacccggggttcacgatcctcgccctgttcctggcccactacatcggcacctccctcacccagaaggtggtgatcttcatcctgctgatgctcgtgacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgcggtggtgcaggccgacaccgggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgcgggcgcctgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgcggtgcacgccgacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgcgggcagcgggaaggtggacaacttcacgatgggcgtgctgtgcctcgccatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgcgctgatcgccaccttcaagatccagcccttcctggccctcgggttcttcctgcgcaagctgaccagccgggagaacctcctgctgggcgtgggcctcgccatggcgaccacgctgcagctgcccgaggacatcgagcagatggccaacgggatcgccctcggcctgatggccctgaagctcatcacccagttcgagacctaccagctgtggaccgccctgatcagcctcacgtgctccaacaccatcttcaccctgaccgtggcgtggcgcacggccaccctgatcctcgccggggtcagcctgctgccggtgtgccagtccagctccatgcggaagtccgactggctccccatgaccgtcgccgccatgggcgtgccgcccctcccgctgttcatcttctccctcaaggacaccctgaagcgccgcagctggcccctgaacgagggggtgatggcggtcggcctcgtgtccatcctggccagctccctgctccggaacgacgtgcccatggccggccccctggtcgccgggggcctgctcatcgcctgctacgtgatcacggggaccagcgcggacctgaccgtggagaaggccgccgacgtcacctgggaggaggaggccgagcagacgggcgtgtcccacaacctgatgatcaccgtggacgacgacgggaccatgcgcatcaaggacgacgagaccgagaacatcctcaccgtcctgctgaagacggccctcctgatcgtgagcggcatcttcccgtactccatccccgcgaccctgctcgtgtggcacacctggcagaagcagacccggcgcagcggcgtcctgtgggacgtgcccagcccgcccgagacgcagaaggccgagctggaggagggggtgtaccggatcaagcagcagggcatcttcgggaagacccaggtcggcgtgggggtgcagaaggagggcgtcttccacaccatgtggcacgtgacccgcggcgccgtgctcacgtacaacgggaagcggctggagcccaactgggccagcgtcaagaaggacctgatctcctacggcgggggctggcgcctcagcgcgcagtggcagaagggggaggaggtccaggtgatcgccgtcgagcccggcaagaaccccaagaacttccagaccatgcccggcaccttccagaccacgaccggggagatcggcgccatcgccctggacttcaagcccgggaccagcggctcccccatcatcaaccgggagggcaaggtggtggggctgtacggcaacggggtcgtgaccaagaacggcgggtacgtgagcggcatcgcccagacgaacgcggagccggacggccccacccccgagctggaggaggagatgttcaagaagcgcaacctcaccatcatggacctgcaccccgggtccggcaagacccggaagtacctgccggccatcgtccgcgaggccatcaagcggcgcctccggacgctgatcctggcccccacccgcgtggtggccgcggagatggaggaggccctcaaggggctgcccatccggtaccagaccaccgccaccaagagcgagcacaccggccgcgagatcgtcgacctgatgtgccacgccaccttcaccatgcggctcctgtcccccgtgcgcgtgccgaactacaacctgatcatcatggacgaggcccacttcacggaccccgcgagcatcgccgcccgggggtacatctccacccgcgtcggcatgggcgaggccgcggccatcttcatgaccgccacgccgcccgggacggccgacgccttcccgcagagcaacgcgcccatccaggacgaggagcgcgacatccccgagcggtcctggaacagcggcaacgagtggatcaccgacttcgccgggaagaccgtgtggttcgtgccctccatcaaggccggcaacgacatcgccaactgcctccgcaagaacgggaagaaggtcatccagctgagccggaagaccttcgacacggagtaccagaagaccaagctgaacgactgggacttcgtggtgaccaccgacatctccgagatgggcgccaacttcaaggcggaccgcgtcatcgacccgcggcgctgcctcaagcccgtgatcctgacggacggccccgagcgggtgatcctggccgggcccatgccggtcaccgccgccagcgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagagccgcaagacgttcgtggagctgatgcggcgcggggacctccccgtctggctggcccacaaggtggcctccgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacctacagcgacccgctggcgctcaaggagttcaaggacttcgccgccggccggaagtccatcgccctggacctggtgacggagatcgggcgcgtgcccagccacctcgcccaccggacccgcaacgcgctggacaacctggtcatgctccacaccagcgagcacggcgggaaggcctaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtgatcgcctccagcggcatgctctggatggcggagatcccgctgcagtggatcgcctccgccatcgtcctggagttcttcatgatggtgctcctgatccccgagcccgagaagcagcgcacgccccaggacaaccagctggcctacgtggtcatcgggatcctcacgctggccgcgatcatcgccgccaacgagatgggcctgctcgagaccaccaagcgggacctgggcatgagcaaggagccgggggtggtgtcccccaccagctacctggacgtcgacctccaccccgcctccgcgtggacgctgtacgccgtggccaccaccgtgatcacccccatgctgcgccacacgatcgagaacagcaccgccaacgtctccctcgccgcgatcgccaaccaggccgtggtgctgatgggcctggacaaggggtggccgatcagcaagatggacctcggcgtccccctgctggccctcgggtgctactcccaggtgaaccccctgaccctgaccgccgcggtgctcctgctgatcacgcactacgccatcatcggccccggcctccaggccaaggccacccgggaggcccagaagcgcaccgcggccgggatcatgaagaacccgaccgtcgacggcatcatgacgatcgacctggaccccgtgatctacgacagcaagttcgagaagcagctgggccaggtgatgctcctggtcctgtgcgccgtgcagctcctgctgatgcggacctcctgggccctctgcgaggcgctgaccctggccaccggccccatcacgaccctctgggagggcagccccgggaagttctggaacaccaccatcgccgtgtccatggccaacatcttccgcggcagctacctggccggggcgggcctggccttctccatcatgaagtccgtcgggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgccgtgtcccggggcagcgccaagctgcagtggttcgtcgagcgcaacatggtgatcccggaggggcgggtgatcgacctcggctgcgggcgcggcgggtggtcctactactgcgcgggcctgaagaaggtcaccgaggtgcggggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacgcacgagatgtactggatcagcaacggcaccgggaacatcgtggcctccgtcaacatggtgagccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtgaaggcgaccgggtccgccagcagcatgatcaacggcgtcgtgaagctgctgaccaagccctgggacgtcgtgcccatggtgacccagatggccatgacggacaccacccccttcgggcagcagcgcgtcttcaaggagaaggtggacacccggacgccgcgctccatgcccggcacccggcgcgtgatgggcatcaccgccgagtggctctggcggaccctggggcgcaacaagaagccccggctgtgcacgcgcgaggagttcaccaagaaggtccgcaccaacgcggccatgggcgccgtgttcaccgaggagaaccagtgggacagcgccaaggccgcggtggaggacgaggacttctggaagctcgtcgaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgcgatgtacgccgacgacacggccgggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcggcagcggccaggtgggcacctacgggctgaacacgttcaccaacatggaggcgcagctcatccggcagatggagggcgagggggtgctgaccaaggccgacctggagaacccccacctctccgagaagaagatcacccagtggctggagacgaagggcgtcgagcgcctgaagcggatggccatcagcggcgacgactgcgtggtgaagccgatcgacgaccgcttcgccaacgccctcctggcgctgaacgacatggggaaggtccggaaggacatcccccagtggcagccctccaagggctggcacgactggcagcaggtccccttctgcagccaccacttccacgagctcatcatgaaggacgggcgcaagctggtggtcccgtgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtgcccgtgcactgggtccccaccagccggaccacgtggagcatccacgcgcaccaccagtggatgaccaccgaggacatgctgaccgtgtggaaccgcgtgtggatcgaggacaacccgtggatggaggacaagacgcccgtcaccacctgggagaacgtgccctacctcgggaagcgggaggaccagtggtgcggctccctgatcgggctgaccagccgcgccacgtgggcccagaacatccccaccgccatccagcaggtccggtccctcatcggcaacgaggagttcctggactacatgccgagcatgaagcgcttccggaaggaggaggagtccgagggggccatctggtga

SEQ ID NO: 10176 - RNA, 9873 nt, synthetic construct
  misc_feature 1..9873: note = derived and/or modified CDS sequence (opt1) from DENV-3__FJ390372__SS-prME
  source 1..9873: mol_type = other RNA
accagcctgtgcctcatgatggtgctgcccgccgccctggcgttccacctcaccagccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgcgccgtgcaagatccccttcagcaccgaggacgggcagggcaaggcccacaacggccgcctgatcacggccaaccccgtggtgaccaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacacggccctgttcagcggcgtgtcctgggtcatgaagatcggcatcggggtgctcctgacctggatcggcctgaacagcaagaacacctccatgagcttctcctgcatcgccatcggggtgatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggccgggcccatctcccagcacaaccaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgcgatcctgttcgaggaggtgatgcgggggaagttcggcaagaagcacatgatcgccggggtcttcttcaccttcgtgctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtcggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatgttcaccctgaccgtggcctggcgcacggcgaccctgatcctcgccggggtcagcctgctgccggtgtgccagtccagctccatgcggaagaccgactggctccccatggccgtggccgccatgggcgtgccgcccctcccgctgttcatcttcagcctcaaggacaccctgaagcgccgctcctggcccctgaacgagggggtgatggcggtgggcctcgtcagcatcctggcctccagcctgctccggaacgacgtgcccatggccggccccctggtggccgggggcctgctcatcgcctgctacgtcatcacggggacctccgcggacctgaccgtggagaaggccgccgacatcacctgggaggaggaggccgagcagacgggcgtgagccacaacctgatgatcaccgtcgacgacgacgggaccatgcgcatcaaggacgacgagaccgagaacatcctcaccgtgctgctgaagacggccctcctgatcgtgtccggcgtcttcccgtacagcatccccgcgaccctgctcgtgtggcacacctggcagaagcagacccagcggtccggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgccgtgctcacgtacaacgggaagcgcctggagcccaactgggcctccgtgaagaaggacctgatcagctacggcgggggctggcggctctccgcgcagtggcagaagggggaggaggtccaggtgatcgccgtggagcccggcaagaaccccaagaacttccagaccatgcccggcaccttccagaccacgaccggggagatcggcgccatcgccctggacttcaagcccgggaccagcggcagccccatcatcaaccgcgagggcaaggtcgtggggctgtacggcaacggggtggtcaccaagaacggcgggtacgtgtccggcatcgcccagacgaacgcggagccggacggccccacccccgagctggaggaggagatgttcaagaagcggaacctcaccatcatggacctgcaccccgggagcggcaagacccgcaagtacctgccggccatcgtgcgggaggccatcaagcgccggctccgcacgctgatcctggcccccacccgggtcgtggccgcggagatggaggaggccctcaaggggctgcccatccgctaccagaccaccgccacgaagtccgagcacaccggccgggagatcgtggacctgatgtgccacgccaccttcaccatgcgcctcctgagccccgtccgggtgccgaactacaacctgatcatcatggacgaggcccacttcacggaccccgcgtccatcgccgcccgcgggtacatcagcacccgggtgggcatgggcgaggccgcggccatcttcatgaccgccacgccgcccgggacggccgacgccttcccgcagtccaacgcgcccatccaggacgaggagaaggacatccccgagcgcagctggaactccggcaacgagtggatcaccgacttcgccgggaagaccgtctggttcgtgcccagcatcaaggccggcaacgacatcgccaactgcctccgcaagaacgggaagaaggtgatccagctgtcccggaagaccttcgacacggagtaccagaagaccaagctgaacgactgggacttcgtcgtgaccaccgacatcagcgagatgggcgccaacttcaaggcggaccgcgtgatcgacccgcggcgctgcctcaagcccgtcatcctgacggacggccccgagcgggtgatcctggccgggcccatgccggtgaccgccgcctccgccgcgcagcgccggggccgcgtcgggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagtcccgcaagacgttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccggacctactccgacccgctggcgctcaaggagttcaaggacttcgccgccggccgcaagagcatcgccctggacctggtcacggagatcgggcgcgtgccctcccacctcgcccaccggacccgcaacgcgctggacaacctggtgatgctccacaccagcgagcacggcgggcgggcctaccgccacgccgtcgaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtgctggagttcttcatgatggtcctcctgatccccgagcccgagaagcagcggacgccccaggacaaccagctggcctacgtggtgatcgggatcctcacgctggccgcgatcatcgccgccaacgagatgggcctgctcgagaccaccaagcgcgacctgggcatgtccaaggagccgggggtcgtgagccccacctcctacctggacgtggacctccaccccgccagcgcgtggacgctgtacgccgtcgccaccaccgtgatcacccccatgctgcggcacacgatcgagaactccaccgccaacgtgagcctcgccgcgatcgccaaccaggccgtcgtgctgatgggcctggacaaggggtggccgatctccaagatggacctcggcgtgcccctgctggccctcgggtgctacagccaggtcaaccccctgaccctgaccgccgcggtgctcctgctgatcacgcactacgccatcatcggccccggcctccaggccaaggccacccgcgaggcccagaagcggaccgcggccgggatcatgaagaacccgaccgtggacggcatcatgacgatcgacctggaccccgtcatctacgactccaagttcgagaagcagctggggcaggtcatgctcctggtgctgtgcgccgtccagctcctgctgatgcgcaccagctgggccctctgcgaggcgctgaccctggccaccggccccatcacgaccctctgggagggctcccccgggaagttctggaacaccaccatcgccgtgagcatggccaacatcttccggggctcctacctggccggggcgggcctggccttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtcgaccgcaccgaggccaaggaggggctgaagcggggcgagacgacccaccacgccgtgagccgcggcaccgccaagctgcagtggttcgtggagcggaacatggtcatcccggaggggcgcgtgatcgacctcggctgcgggcggggcgggtggtcctactactgcgcgggcctgaagaaggtgaccgaggtccgcggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccggacgatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcaccgggaacatcgtggcctccgtgaacatggtcagccgcctcctgctgaaccggttcacgatgacccaccgccggccgaccatcgagaaggacgtggacctcggcgccggcacccgccacgtgaacgccgagcccgagacgcccaacatggacgtcatcggggagcggatcaagcgcatcaaggaggagcacaactccacctggcactacgacgacgagaacccgtacaagacctgggcctaccacggcagctacgaggtgaaggcgaccgggtccgccagctccatgatcaacggcgtcgtgaagctgctgacgaagccctgggacgtggtccccatggtgacccagatggccatgaccgacaccacgcccttcgggcaccagcgggtgttcaaggagaaggtcgacacccgcaccccgcggagcatgcccggcccccgccgggccatgggcatcaccgcggagtggctctggcgcacgctggggcggaacaagaagccccgcctgtgcacccgggaggagttcaccaagaagggccgcaccaacgccgccatgggggccgtgttcacggaggagaaccagtgggacagcgccaaggcggccgtggaggacgaggacttctggaagctcgtcgaccgcgagcgggagctgcacaagctgggcaagtgcgggtcctgcgtgtacaacatgatgggcaagcgcgagaagaagctcggcgagttcgggaaggccaagggcagccgggccatctggtacatgtggctgggggcccgctacctggagttcgaggcgctcggcttcctgaacgaggaccactggttctcccgggagaacagctactccggggtggagggcgagggcctgcacaagctcgggtacatcctgcgcgacatcagcaagatcccgggcggggccatgtacgccgacgccaccgccggctgggacacccggatcaccgaggacgacctgcacaacgaggagaagatcacgcagcagatggaccccgaccaccgccagctcgcgaccgccatcttcaagctgacctaccagaacaaggtcgtgaaggtgcagcggcccacccccaccggcacggtcatggacatcatctcccgcaaggaccagcgggggagcggccaggtggggacctacggcctgaacaccttcaccaacatggaggcccagctcatccgccagatggagggggagggcgtgctgtccaaggccgacctggagaacccgcacctccccgagaagaagatcacgcagtggctggagaccaagggcgtcgagcggctgcgccggatggccatcagcggggacgactgcgtggtgaagcccatcgacgaccgcttcgcgaacgccctcctggccctgaacgacatgggcaaggtccggaaggacatcccccagtggcagccgtccaaggggtggcacgactggcagcaggtccccttctgcagccaccacttccacgagctcatcatgaaggacggccgcaagctggtggtcccctgccggccccaggacgagctgatcgggcgcgcccggatctcccagggcgcgggctggagcctccgcgagaccgcctgcctggggaaggcctacgcccagatgtggtccctgatgtacttccaccgccgggacctccgcctggccagcaacgcgatctgctccgccgtgccggtgcactgggtccccaccagccggacgacctggtccatccacgcccaccaccagtggatgaccaccgaggacatgctgacggtgtggaaccgcgtgtggatcgaggacaacccctggatggaggacaagacccccgtcaccacctgggagaacgtgccgtacctcggcaagcgggaggaccagtggtgcgggagcctgatcggcctgacgagccgcgccacctgggcccagaacatccccaccgcgatccagcaggtccggtccctcatcgggaacgaggagttcctggactacatgcccagcatgaagcgcttccggaaggaggaggagtccgagggcgccatctggtga

SEQ ID NO: 10177 - RNA, 9873 nt, synthetic construct
  misc_feature 1..9873: note = derived and/or modified CDS sequence (opt1) from DENV-3__FJ205870__SS-prME
  source 1..9873: mol_type = other RNA
accagcctgtgcctcatgatgatcctgcccgccgccctggccttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtggcgctcgcgccccacgtgggcatggggctggacacgcgcacccagacctggatgagcgccgagggcgcctggcgccaggtggagaaggtggagacctgggcgctgcgccacccggggttcacgatcctcgccctgttcctggcccactacatcggcacctccctcacccagaaggtggtgatcttcatcctgctgatgctcgtgacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcatcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcatcctgccggtgtgccagtccagctccatgcggaagtccgactggctgcccatgaccgtcgccgccatgggcgtgccgcccctcccgctgttcatcttctccctgaaggacaccctcaagcgccgcagctggcccctgaacgagggggtgatggccgtcggcctggtgtccatcctcgcgagctccctgctgcggaacgacgtgcccatggccggccccctcgtcgccgggggcctgctgatcgcctgctacgtgatcacggggaccagcgccgacctcaccgtggagaaggcggccgacgtcacctgggaggaggaggccgagcagacgggcgtgtcccacaacctgatgatcaccgtggacgacgacgggaccatgcgcatcaaggacgacgagaccgagaacatcctgaccgtcctcctgaagacggccctgctcatcgtgagcggcatcttcccgtactccatccccgccaccctgctggtgtggcacacctggcagaagcagacccggcgcagcggcgtcctctgggacgtgcccagcccgcccgagacgcagaaggcggagctggaggagggggtgtaccggatcaagcagcagggcatcttcgggaagacccaggtcggcgtgggggtgcagaaggagggcgtcttccacaccatgtggcacgtgacccgcggcgccgtgctgacgtacaacgggaagcggctcgagcccaactgggccagcgtcaagaaggacctgatctcctacggcgggggctggcgcctgagcgcccagtggcagaagggggaggaggtccaggtgatcgcggtcgagcccggcaagaaccccaagaacttccagaccatgcccggcaccttccagaccacgaccggggagatcggcgccatcgccctcgacttcaagcccgggaccagcggctcccccatcatcaaccgggagggcaaggtggtggggctgtacggcaacggggtcgtgaccaagaacggcgggtacgtgagcggcatcgcccagacgaacgccgagccggacggccccacccccgagctggaggaggagatgttcaagaagcgcaacctgaccatcatggacctccaccccgggtccggcaagacccggaagtacctgccggcgatcgtccgcgaggccatcaagcggcgcctgcggacgctcatcctggcccccacccgcgtggtggccgccgagatggaggaggcgctgaaggggctccccatccggtaccagaccaccgccaccaagagcgagcacaccggccgcgagatcgtcgacctgatgtgccacgccaccttcaccatgcggctgctctcccccgtgcgcgtgccgaactacaacctgatcatcatggacgaggcccacttcacggaccccgccagcatcgcggcccgggggtacatctccacccgcgtcggcatgggcgaggccgccgcgatcttcatgaccgccacgccgcccgggacggccgacgccttcccgcagagcaacgcccccatccaggacgaggagcgcgacatccccgagcggtcctggaacagcggcaacgagtggatcaccgacttcgcggggaagaccgtgtggttcgtgccctccatcaaggccggcaacgacatcgccaactgcctgcgcaagaacgggaagaaggtcatccagctcagccggaagaccttcgacacggagtaccagaagaccaagctgaacgactgggacttcgtggtgaccaccgacatctccgagatgggcgccaacttcaaggccgaccgcgtcatcgacccgcggcgctgcctgaagcccgtgatcctcacggacggccccgagcgggtgatcctggcggggcccatgccggtcaccgccgccagcgccgcccagcgccggggccgcgtggggcggaacccccagaaggagaacgaccagtacatcttcaccggccagcccctgaacaacgacgaggaccacgcgcactggaccgaggccaagatgctcctggacaacatcaacacccccgaggggatcatcccggccctgttcgagcccgagcgcgagaagtccgccgcgatcgacggcgagtaccggctcaagggcgagagccgcaagacgttcgtggagctgatgcggcgcggggacctgcccgtctggctcgcccacaaggtggcctccgagggcatcaagtacaccgaccggaagtggtgcttcgacgggcagcgcaacaaccagatcctggaggagaacatggacgtcgagatctggaccaaggagggcgagaagaagaagctgcggccccgctggctcgacgcccgcacctacagcgacccgctggccctgaaggagttcaaggacttcgcggccggccggaagtccatcgccctcgacctggtgacggagatcgggcgcgtgcccagccacctggcccaccggacccgcaacgccctcgacaacctggtcatgctgcacaccagcgagcacggcgggaaggcgtaccggcacgccgtggaggagctccccgagaccatggagacgctgctgctcctgggcctgatgatcctcctgaccgggggcgccatgctgttcctcatctccggcaaggggatcggcaagaccagcatcgggctgatctgcgtgatcgcctccagcggcatgctgtggatggccgagatcccgctccagtggatcgcgtccgccatcgtcctggagttcttcatgatggtgctgctcatccccgagcccgagaagcagcgcacgccccaggacaaccagctggcctacgtggtcatcgggatcctgacgctcgccgccatcatcgcggccaacgagatgggcctgctggagaccaccaagcgggacctcggcatgagcaaggagccgggggtggtgtcccccaccagctacctggacgtcgacctgcaccccgcctccgcctggacgctctacgcggtggccaccaccgtgatcacccccatgctgcgccacacgatcgagaacagcaccgccaacgtctccctggccgccatcgcgaaccaggccgtggtgctcatgggcctggacaaggggtggccgatcagcaagatggacctgggcgtccccctcctggccctggggtgctactcccaggtgaaccccctcaccctgaccgccgccgtgctgctcctgatcacgcactacgcgatcatcggccccggcctgcaggccaaggccacccgggaggcccagaagcgcaccgccgcggggatcatgaagaacccgaccgtcgacggcatcatgacgatcgacctcgaccccgtgatctacgacagcaagttcgagaagcagctgggccaggtgatgctgctcgtcctgtgcgccgtgcagctgctcctgatgcggacctcctgggccctgtgcgaggccctcaccctggcgaccggccccatcacgaccctgtgggagggcagccccgggaagttctggaacaccaccatcgccgtgtccatggccaacatcttccgcggcagctacctcgccggggccggcctggcgttctccatcatgaagtccgtcgggacgggcaagcggggcaccgggagccagggcgagaccctgggggagaagtggaagaagaagctcaaccagctgtcccgcaaggagttcgacctgtacaagaagtccggcatcaccgaggtggaccggaccgaggccaaggaggggctcaagcgcggcgagatcacgcaccacgccgtgtcccggggcagcgccaagctgcagtggttcgtcgagcgcaacatggtgatcccggaggggcgggtgatcgacctgggctgcgggcgcggcgggtggtcctactactgcgccggcctcaagaaggtcaccgaggtgcggggctacaccaagggcgggcccgggcacgaggagcccgtgcccatgagcacctacggctggaacatcgtcaagctgatgtccgggaaggacgtgttctacctgccgcccgagaagtgcgacacgctcctgtgcgacatcggcgagagctcccccagccccaccgtggaggagtcccgcaccatccgcgtcctgaagatggtggagccgtggctgaagaacaaccagttctgcatcaaggtgctcaacccctacatgcccaccgtcatcgagcacctggagcggctgcagcgcaagcacggcgggatgctcgtgcggaaccccctgagccgcaactccacgcacgagatgtactggatcagcaacggcaccgggaacatcgtggcgtccgtcaacatggtgagccggctgctcctgaaccgcttcaccatgacccaccggcgcccgacgatcgagaaggacgtggacctgggcgccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtgaaggccaccgggtccgcgagcagcatgatcaacggcgtcgtgaagctcctgaccaagccctgggacgtcgtgcccatggtgacccagatggccatgacggacaccacccccttcgggcagcagcgcgtcttcaaggagaaggtggacacccggacgccgcgctccatgcccggcacccggcgcgtgatgggcatcaccgccgagtggctgtggcggaccctcgggcgcaacaagaagccccggctgtgcacgcgcgaggagttcaccaagaaggtccgcaccaacgccgcgatgggcgccgtgttcaccgaggagaaccagtgggacagcgccaaggccgccgtggaggacgaggacttctggaagctggtcgaccgggagcgcgagctccacaagctggggaagtgcggctcctgcgtgtacaacatgatggggaagcgggagaagaagctgggcgagttcggcaaggcgaaggggagccgcgccatctggtacatgtggctcggcgcccggtacctggagttcgaggccctggggttcctcaacgaggaccactggttctcccgcgagaacagctactccggcgtggagggggagggcctgcccaagctgggctacatcctccgggacatcagcaagatccccggcggggccatgtacgcggacgacacggccgggtgggacacccgcatcaccgaggacgacctgcacaacgaggagaagatcacccagcagatggaccccgagcaccggcagctggccaacgccatcttcaagctcacgtaccagaacaaggtcgtgaaggtgcagcgccccacccccaccgggaccgtcatggacatcatctcccggaaggaccagcgcggcagcggccaggtgggcacctacgggctgaacacgttcaccaacatggaggcccagctgatccggcagatggagggcgagggggtgctctccaaggcggacctggagaacccgcacctgagcgagaagaagatcacccagtggctcgagaccaagggcgtcgagcgcctgaagcggatggccatctccggcgacgactgcgtggtgaagcccatcgacgaccgcttcgccaacgccctgctcgccctgaacgacatggggaaggtccggaaggacatcccccagtggcagcccagcaagggctggcacgactggcagcaggtcccgttctgctcccaccacttccacgagctgatcatgaaggacgggcgcaagctcgtggtcccctgccggccccaggacgagctgatcggccgcgcgcggatcagccagggggccggctggtccctgcgcgagacggcctgcctcggcaaggcctacgcgcagatgtggagcctgatgtacttccaccgccgggacctgcgcctcgcctccaacgccatctgcagcgccgtgcccgtgcactgggtcccgaccagccggaccacctggtccatccacgcccaccaccagtggatgacgaccgaggacatgctgaccgtgtggaaccgcgtgtggatcgaggacaacccctggatggaggacaagacccccgtcacgacctgggagaacgtgccctacctggggaagcgggaggaccagtggtgcggcagcctcatcgggctgacctcccgcgcgacctgggcccagaacatcccgacggccatccagcaggtccggagcctgatcggcaacgaggagttcctcgactacatgccctccatgaagcgcttccggaaggaggaggagagcgagggggccatctggtga

SEQ ID NO: 10178 - RNA, 9873 nt, synthetic construct
  misc_feature 1..9873: note = derived and/or modified CDS sequence (opt1) from DENV-3__FJ390373__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcgcggcaaggcgcacaacggccggctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccgcggcgcccggcgcatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccggagcacgacccgcatggagaacctgctgtggaagcagatcgcgaacgagctcaactacatcctgtgggagaacaacatcaagctgaccgtggtcgtgggggacaccatcggcgtgctcgagcagggcaagcggacgctgacgccccagccgatggagctgaagtactcctggaagacctgggggaaggccaagatcgtcaccgccgagacgcagaacagctccttcatcatcgacggccccaacacccccgagtgccccagcgcctcccgcgcgtggaacgtgtgggaggtggaggactacgggttcggcgtcttcaccaccaacatctggctcaagctgcgggaggtgtacacccagctgtgcgaccaccgcctcatgagcgccgccgtgaaggacgagcgggccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgttcttcaccttcgtcctgctcctgtccggccagatcacctggcgggacatggcccacacgctgatcatgatcggcagcaacgcctccgaccgcatggggatgggcgtgacctacctcgccctgatcgccaccttcaagatccagcccttcctggcgctcgggttcttcctgcggaagctgaccagccgcgagaacctcctgctgggcgtgggcctcgccatggccacgaccctgcagctgcccgaggacatcgagcagatggccaacgggatcgcgctcggcctgatggccctgaagctcaccacccagttcgagacgtaccagctgtggaccgccctgatcagcctgacctgctccaacaccatcttcacgctgaccgtcgcctggcggaccgccaccctgatcctcgcgggggtgagcctgctgccggtctgccagtccagctccatgcgcaagacggactggctccccatgaccgtggccgccatgggcgtgccgcccctcccgctgttcatcttcagcctcaaggacaccctgaagcgccggtcctggcccctgaacgagggggtcatggccgtgggcctcgtgagcatcctggcctccagcctgctccgcaacgacgtccccatggcgggccccctggtggccgggggcctgctcatcgcctgctacgtgatcaccgggacgtccgccgacctgaccgtcgagaaggccgcggacgtgacctgggaggaggaggccgagcagaccggcgtgagccacaacctgatgatcaccgtcgacgacgacgggacgatgcggatcaaggacgacgagaccgagaacatcctcaccgtgctgctgaagaccgccctcctgatcgtgtccggcatcttcccgtacagcatccccgccacgctgctcgtctggcacacctggcagaagcagacccagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacccgcggcgcggtcctcacctacaacgggaagcggctggagcccaactgggcctccgtgaagaaggacctgatcagctacggcgggggctggcgcctctccgcccagtggcagaagggggaggaggtgcaggtcatcgccgtggagcccggcaagaaccccaagaacttccagacgatgcccggcaccttccagaccaccacgggggagatcggcgcgatcgccctggacttcaagcccgggaccagcggcagccccatcatcaaccgggagggcaaggtggtcgggctgtacggcaacggggtggtgaccaagaacggcgggtacgtctccggcatcgcccagaccaacgccgagccggacggccccacgcccgagctggaggaggagatgttcaagaagcgcaacctcaccatcatggacctgcaccccgggagcggcaagacccggaagtacctgccggccatcgtgcgcgaggcgatcaagcggcgcctccggaccctgatcctggcccccacgcgcgtggtcgccgccgagatggaggaggccctcaaggggctgcccatccggtaccagaccaccgcgaccaagtccgagcacacgggccgcgagatcgtggacctgatgtgccacgccaccttcaccatgcggctcctgagccccgtgcgcgtcccgaactacaacctgatcatcatggacgaggcccacttcaccgaccccgcctccatcgccgcgcgggggtacatcagcacgcgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcacggacttcgccgggaagaccgtgtggttcgtccccagcatcaaggcgggcaacgacatcgccaactgcctccgcaagaacgggaagaaggtgatccagctgtcccggaagaccttcgacaccgagtaccagaagacgaagctgaacgactgggacttcgtggtcaccaccgacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcacgggccagcccctcaacaacgacgaggaccacgcccactggaccgaggcgaagatgctgctggacaacatcaacacccccgaggggatcatcccggccctcttcgagcccgagcgcgagaagtccgccgccatcgacggcgagtaccggctgaagggcgagtcccgcaagaccttcgtcgagctgatgcggcgcggggcgctccccgtgtggctggcccacaaggtcgccagcgagggcatcaagtacacggaccggaagtggtgcttcgacgggcagcgcaacaaccagatcctggaggagaacatggacgtggagatctggaccaaggagggcgagaagaagaagctccggccccgctggctggacgcccgcacctactccgacccgctggccctcaaggagttcaaggacttcgcggccggccgcaagagcatcgccctggacctggtgaccgagatcgggcgcgtcccctcccacctcgcccaccggacgcgcaacgccctggacaacctggtgatgctccacaccagcgagcacggcgggaaggcgtaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggccgagatcccgctgcagtggatcgcgagcgccatcgtgctggagttcttcatgatggtgctcctgatccccgagcccgagaagcagcgcacgccccaggacaaccagctggcctacgtcgtgatcgggatcctcaccctggccgccatcatcgcggccaacgagatgggcctgctcgagacgaccaagcgggacctgggcatgtccaaggagccgggggtggtcagccccacctcctacctggacgtggacctccaccccgccagcgcctggaccctgtacgcggtggccacgaccgtcatcacccccatgctgcgccacaccatcgagaactccacggccaacgtgagcctcgccgccatcgcgaaccaggccgtggtcctgatgggcctggacaaggggtggccgatctccaagatggacctcggcgtgcccctgctggccctcgggtgctacagccaggtgaaccccctgaccctgaccgccgccgtcctcctgctgatcacccactacgcgatcatcggccccggcctccaggccaaggccacgcgggaggcccagaagcgcaccgccgcggggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcggacgagctgggccctctgcgaggccctgaccctggcgaccggccccatcaccacgctctgggagggctcccccgggaagttctggaacaccaccatcgccgtcagcatggccaacatcttccgcggctcctacctggccggggccggcctggcgttcagcatcatgaagtccgtggggaccggcaagcggggcaccgggagccagggcgagacgctcggggagaagtggaagaagaagctgaaccagctgagccgcaaggagttcgacctctacaagaagtccggcatcaccgaggtggaccggaccgaggccaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgacggaggtgcggggctacaccaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccacggtcgaggagagccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgtcccgcaacagcacccacgagatgtactggatctccaacggcacggggaacatcgtcgcgagcgtgaacatggtgtcccggctcctgctgaaccgcttcaccatgacccaccggcgcccgaccatcgagaaggacgtcgacctcggcgccggcacgcggcacgtgaacgccgagcccgagacccccaacatggacgtgatcggggagcgcatcaagcggatcaaggaggagcacaacagcacctggcactacgacgacgagaacccgtacaagacctgggcctaccacggctcctacgaggtcaaggccacggggagcgcgtccagcatgatcaacggcgtggtcaagctgctgaccaagccctgggacgtggtgcccatggtcacccagatggccatgaccgacacgacccccttcgggcagcagcgcgtgttcaaggagaaggtggacacccggaccccgcgcagcatgcccggcacgcggcgcgtcatgggcatcaccgccgagtggctctggcggaccctggggcgcaacaagaagccccggctgtgcacccgcgaggagttcacgaagaaggtgcgcaccaacgccgcgatgggcgccgtgttcaccgaggagaaccagtgggactccgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgcggacgacaccgccgggtgggacacgcgcatcaccgaggacgacctgcacaacgaggagaagatcacccagcagatggacccggagcaccggcagctcgccaacgccatcttcaagctgacctaccagaacaaggtggtgaaggtccagcgccccacccccacgggcaccgtgatggacatcatcagccggaaggaccagcgcggctccggccaggtgggcacctacgggctgaacaccttcacgaacatggaggcccagctcatccggcagatggagggcgagggggtcctgagcaaggcggacctggagaacccccacctcccggagaagaagatcacccagtggctggagaccaagggcgtggagcgcctgaagcggatggccatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcgcggatcagccagggggccggctggtccctccgcgagaccgcctgcctgggcaaggcctacgcgcagatgtggagcctgatgtacttccaccgccgggacctccgcctggcctccaacgccatctgcagcgccgtgcccgtccactgggtgccgacgtcccggaccacctggagcatccacgcccaccaccagtggatgaccacggaggacatgctgaccgtgtggaaccgcgtctggatcgaggacaacccctggatggaggacaagacccccgtgaccacgtgggagaacgtgccctacctcgggaagcgggaggaccagtggtgcggcagcctgatcgggctgacctcccgcgcgacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10179 - RNA, 9873 nt, synthetic construct
  misc_feature 1..9873: note = derived and/or modified CDS sequence (opt1) from DENV-3__FJ205871__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggcctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacacgctgatcatgatcggcagcaacgcctccgaccggatggggatgggcgtcacctacctcgccctgatcgcgaccttcaagatccagcccttcctggccctcgggttcttcctgcgcaagctgaccagccgggagaacctcctgctgggcgtgggcctcgccatggccacgaccctgcagctgcccgaggacatcgagcagatggcgaacgggatcgccctcggcctgatggccctgaagctcaccacccagttcgagacgtaccagctgtggaccgccctgatcagcctgacctgctccaacaccatcttcacgctgaccgtggcctggcgcaccgcgaccctgatcctcgccggggtcagcctgctgccggtgtgccagtccagctccatgcggaagacggactggctccccatgaccgtcgccgccatgggcgtgccgcccctcccgctgttcatcttcagcctcaaggacaccctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacgtccgccgacctgaccgtggagaaggcggccgacgtcacctgggaggaggaggccgagcagaccggcgtgagccacaacctgatgatcaccgtggacgacgacgggacgatgcgcatcaaggacgacgagaccgagaacatcctcaccgtcctgctgaagaccgccctcctgatcgtgtccggcatcttcccgtacagcatccccgccacgctgctcgtgtggcacacctggcagaagcagacccagcggtccggcgtcctgtgggacgtgcccagcccgcccgagacccagaaggcggagctggaggagggggtgtaccgcatcaagcagcagggcatcttcgggaagacgcaggtcggcgtgggggtgcagaaggagggcgtcttccacaccatgtggcacgtgacccggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagacgatgcccggcaccttccagaccaccacgggggagatcggcgccatcgccctggacttcaagcccgggaccagcggcagccccatcatcaaccgcgagggcaaggtggtggggctgtacggcaacggggtcgtgaccaagaacggcgggtacgtgtccggcatcgcccagaccaacgccgagccggacggccccacgcccgagctggaggaggagatgttcaagaagcggaacctcaccatcatggacctgcaccccgggagcggcaagacccgcaagtacctgccggcgatcgtccgggaggccatcaagcgccggctccgcaccctgatcctggcccccacgcgggtggtggccgccgagatggaggaggcgctcaaggggctgcccatccgctaccagaccaccgccaccaagtccgagcacacgggccgggagatcgtcgacctgatgtgccacgccaccttcaccatgcgcctcctgagccccgtgcgggtgccgaactacaacctgatcatcatggacgaggcccacttcaccgaccccgcctccatcgcggcccgcgggtacatcagcacgcgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcacggacttcgcggggaagaccgtgtggttcgtgcccagcatcaaggccggcaacgacatcgccaactgcctccggaagaacgggaagaaggtcatccagctgtcccgcaagaccttcgacaccgagtaccagaagacgaagctgaacgactgggacttcgtggtgaccaccgacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcacgggccagcccctcaacaacgacgaggaccacgcgcactggaccgaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgcggccggccgcaagagcatcgccctggacctggtgaccgagatcgggcgggtgccctcccacctcgcccaccgcacgcggaacgccctggacaacctggtcatgctccacaccagcgagcacggcgggaaggcgtaccgccacgccgtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagacgaccaagcgcgacctgggcatgtccaaggagccgggggtggtgagccccacctcctacctggacgtcgacctccaccccgccagcgcctggaccctgtacgcggtggccacgaccgtgatcacccccatgctgcggcacaccatcgagaactccacggccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgaccgccgccgtgctcctgctgatcacccactacgcgatcatcggccccggcctccaggccaaggccacgcgcgaggcccagaagcggaccgccgcggggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcgcacgagctgggccctctgcgaggccctgaccctggcgaccggccccatcaccacgctctgggagggctcccccgggaagttctggaacaccaccatcgccgtgagcatggccaacatcttccggggctcctacctggccggggccggcctggcgttcagcatcatgaagtccgtcgggaccggcaagcgcggcaccgggagccagggcgagacgctcggggagaagtggaagaagaagctgaaccagctgagccggaaggagttcgacctctacaagaagtccggcatcaccgaggtggaccgcaccgaggccaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcacggaggtgcgcggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcacggggaacatcgtggcgagcgtcaacatggtgtcccgcctcctgctgaaccggttcaccatgacccaccgccggccgaccatcgagaaggacgtggacctcggcgccggcacgcgccacgtcaacgccgagcccgagacccccaacatggacgtgatcggggagcggatcaagcgcatcaaggaggagcacaacagcacctggcactacgacgacgagaacccgtacaagacctgggcctaccacggctcctacgaggtgaaggccacggggagcgcgtccagcatgatcaacggcgtcgtgaagctgctgaccaagccctgggacgtcgtgcccatggtgacccagatggccatgaccgacacgacccccttcgggcagcagcgggtcttcaaggagaaggtggacacccgcaccccgcggagcatgcccggcacgcgccgggtgatgggcatcaccgccgagtggctctggcgcaccctggggcggaacaagaagccccgcctgtgcacccgggaggagttcacgaagaaggtccgcaccaacgccgcgatgggcgccgtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacgcggatcaccgaggacgacctgcacaacgaggagaagatcacccagcagatggacccggagcaccgccagctcgccaacgccatcttcaagctgacctaccagaacaaggtcgtgaaggtgcagcggcccacccccacgggcaccgtcatggacatcatcagccgcaaggaccagcggggctccggccaggtgggcacctacgggctgaacaccttcacgaacatggaggcccagctcatccgccagatggagggcgagggggtgctgagcaaggcggacctggagaacccccacctcccggagaagaagatcacccagtggctggagaccaagggcgtcgagcggctgaagcgcatggccatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcgcgcatcagccagggggccggctggtccctccgggagaccgcctgcctgggcaaggcctacgcgcagatgtggagcctgatgtacttccaccgccgcgacctccggctggcctccaacgccatctgcagcgccgtgcccgtgcactgggtcccgacgtcccgcaccacctggagcatccacgcccaccaccagtggatgaccacggaggacatgctgaccgtgtggaaccgggtgtggatcgaggacaacccctggatggaggacaagacccccgtcaccacgtgggagaacgtgccctacctcgggaagcgcgaggaccagtggtgcggcagcctgatcgggctgacctcccgggcgacctgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10180 - RNA, 9873 nt, synthetic construct
  misc_feature 1..9873: note = derived and/or modified CDS sequence (opt1) from DENV-3__FJ390375__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcaccacccagttcgagacgtaccagctgtggaccgccctgatcagcctgacctgctccaacaccatcttcacgctgaccgtcgcctggcgcaccgccaccctgatcctcgcgggggtgagcctgctgccggtctgccagtccagctccatgcggaagacggactggctccccatgaccgtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacgtccgccgacctgaccgtcgagaaggccgcggacgtgacctgggaggaggaggccgagcagaccggcgtgagccacaacctgatgatcaccgtcgacgacgacgggacgatgcgcatcaaggacgacgagaccgagaacatcctcaccgtgctgctgaagaccgccctcctgatcgtgtccggcatcttcccgtacagcatccccgccacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagacgatgcccggcaccttccagaccaccacgggggagatcggcgcgatcgccctggacttcaagcccgggaccagcggcagccccatcatcaaccgcgagggcaaggtggtcgggctgtacggcaacggggtggtgaccaagaacggcgggtacgtctccggcatcgcccagaccaacgccgagccggacggccccacgcccgagctggaggaggagatgttcaagaagcggaacctcaccatcatggacctgcaccccgggagcggcaagacccgcaagtacctgccggccatcgtgcgggaggcgatcaagcgccggctccgcaccctgatcctggcccccacgcgggtggtcgccgccgagatggaggaggccctcaaggggctgcccatccgctaccagaccaccgcgaccaagtccgagcacacgggccgggagatcgtggacctgatgtgccacgccaccttcaccatgcgcctcctgagccccgtgcgggtcccgaactacaacctgatcatcatggacgaggcccacttcaccgaccccgcctccatcgccgcgcgcgggtacatcagcacgcgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcacggacttcgccgggaagaccgtgtggttcgtccccagcatcaaggcgggcaacgacatcgccaactgcctccggaagaacgggaagaaggtgatccagctgtcccgcaagaccttcgacaccgagtaccagaagacgaagctgaacgactgggacttcgtggtcaccaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcacgggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtcccctcccacctcgcccaccgcacgcggaacgccctggacaacctggtgatgctccacaccagcgagcacggcgggaaggcctaccgccacgcggtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagacgaccaagcgcgacctgggcatgtccaaggagccgggggtggtcagccccacctcctacctggacgtggacctccaccccgccagcgcctggaccctgtacgccgtggcgacgaccgtcatcacccccatgctgcggcacaccatcgagaactccacggccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgaccgccgccgtcctcctgctgatcacccactacgccatcatcggccccggcctccaggcgaaggccacgcgcgaggcccagaagcggaccgccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcacgagctgggccctctgcgaggccctgaccctggccaccggccccatcaccacgctctgggagggctcccccgggaagttctggaacaccaccatcgcggtcagcatggccaacatcttccggggctcctacctggccggggccggcctggccttcagcatcatgaagtccgtggggaccggcaagcgcggcaccgggagccagggcgagacgctcggggagaagtggaagaagaagctgaaccagctgagccggaaggagttcgacctctacaagaagtccggcatcaccgaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgacggaggtgcgcggctacaccaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccacggtcgaggagagccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcacggggaacatcgtcgccagcgtgaacatggtgtcccgcctcctgctgaaccggttcaccatgacccaccgccggccgaccatcgagaaggacgtcgacctcggcgcgggcacgcgccacgtgaacgccgagcccgagacccccaacatggacgtgatcggggagcggatcaagcgcatcaaggaggagcacaacagcacctggcactacgacgacgagaacccgtacaagacctgggcctaccacggctcctacgaggtcaaggccacggggagcgcctccagcatgatcaacggcgtggtcaagctgctgaccaagccctgggacgtggtgcccatggtcacccagatggcgatgaccgacacgacccccttcgggcagcagcgggtgttcaaggagaaggtggacacccgcaccccgcggagcatgcccggcacgcgccgggtcatgggcatcaccgccgagtggctctggcgcaccctggggcggaacaagaagccccgcctgtgcacccgggaggagttcacgaagaaggtgcgcaccaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtggtgaaggtccagcggcccacccccacgggcaccgtgatggacatcatcagccgcaaggaccagcggggctccggccaggtgggcacctacgggctgaacaccttcacgaacatggaggcccagctcatccgccagatggagggcgagggggtcctgagcaaggccgacctggagaacccccacctcccggagaagaagatcacccagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacgtcccgcaccacctggagcatccacgcccaccaccagtggatgaccacggaggacatgctgaccgtgtggaaccgggtctggatcgaggacaacccctggatggaggacaagacccccgtgaccacgtgggagaacgtgccctacctcgggaagcgcgaggaccagtggtgcggcagcctgatcgggctgacctcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10181 - RNA, 9873 nt, synthetic construct
  misc_feature 1..9873: note = derived and/or modified CDS sequence (opt1) from DENV-3__FJ390376__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcacgctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagcgggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgttcttcaccttcgtcctgctcctgtccggccagatcatctggcgggacatggcccacaccctgatcatgatcggcagcaacgcctccgaccgcatggggatgggcgtgacgtacctcgccctgatcgccaccttcaagatccagcccttcctggcgctcgggttcttcctgcggaagctgaccagccgcgagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcggacggccaccctgatcctcgcgggggtgagcctgctgccggtctgccagtccagctccatgcgcaagaccgactggctccccatgaccgtggccgccatgggcgtgccgcccctcccgctgttcatcttcagcctcaaggacacgctgaagcgccggtcctggcccctgaacgagggggtcatggccgtgggcctcgtgagcatcctggcctccagcctgctccgcaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcggatcaaggacgacgagaccgagaacatcctcacggtgctgctgaagaccgccctcctgatcgtgtccggcatcttcccgtacagcatccccgccaccctgctcgtctggcacacctggcagaagcagacgcagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacgcgcggcgcggtcctcacctacaacgggaagcggctggagcccaactgggcctccgtgaagaaggacctgatcagctacggcgggggctggcgcctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgggagggcaaggtggtcgggctgtacggcaacggggtggtgacgaagaacggcgggtacgtctccggcatcgcccagaccaacgccgagccggacggccccacccccgagctggaggaggagatgttcaagaagcgcaacctcaccatcatggacctgcaccccgggagcggcaagacgcggaagtacctgccggccatcgtgcgcgaggcgatcaagcggcgcctccggaccctgatcctggcccccacccgcgtggtcgccgccgagatggaggaggccctcaaggggctgcccatccggtaccagaccacggcgaccaagtccgagcacaccggccgcgagatcgtggacctgatgtgccacgccaccttcacgatgcggctcctgagccccgtgcgcgtcccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtgtggttcgtccccagcatcaaggcgggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggacttcgccgcgggccgcaagagcatcgccctggacctggtgaccgagatcgggcgcgtcccctcccacctcgcccaccggacccgcaacgccctggacaacctggtgatgctccacaccagcgagcacggcgggaaggcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccaccaagcgggacctgggcatgtccaaggagccgggggtggtcagccccacgtcctacctggacgtggacctccaccccgccagcgcctggaccctgtacgccgtggcgaccaccgtcatcacgcccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccggctgtgcacccgcgaggagttcaccaagaaggtgcgcaccaacgccgccatgggcgcggtgttcacggaggagaaccagtgggactccgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctcatccggcagatggagggcgagggggtcctgagcaaggccgacctggagaacccccacctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10182 - RNA, 9873 nt, synthetic construct
  misc_feature 1..9873: note = derived and/or modified CDS sequence (opt1) from DENV-3__FJ390377__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcacgctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgtccaaggagccgggggtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgacgctggccaccggccccatcaccaccctctgggagggctcccccgggaagttctggaacacgaccatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggccgacctggagaacccccacctcccggagaagaagatcacgcagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10183 - RNA, 9873 nt, synthetic construct
  misc_feature 1..9873: note = derived and/or modified CDS sequence (opt1) from DENV-3__FJ547069__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacctgggcgggaccagcatcttcgccggccacctgaagtgccggctcaagatggacaagctggagctgaagggcatgtcctacgccatgtgcaccaacacgttcgtcctcaagaaggaggtgagcgagacccagcacgggaccatcctgatcaaggtggagtacaagggcgaggacgtcccgtgcaagatccccttctccaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggcagctccatcgggaagatgttcgaggcgaccgcccggggcgcccgccggatggccatcctcggcgacaccgcctgggacttcgggagcgtgggcggggtcctgaactccctgggcaagatggtgcaccagatcttcgggagcgcgtacacggccctcttctccggcgtgagctgggtcatgaagatcggcatcggggtgctgctgacctggatcggcctcaactccaagaacaccagcatgtccttcagctgcatcgccatcgggatcatcaccctgtacctgggcgccgtggtccaggccgacatggggtgcgtgatcaactggaagggcaaggagctcaagtgcggctccgggatcttcgtgacgaacgaggtccacacctggaccgagcagtacaagttccaggcggacagccccaagcgcctggccaccgccatcgccggcgcctgggagaacggggtgtgcggcatccgctccacgacccggatggagaacctgctctggaagcagatcgcgaacgagctgaactacatcctgtgggagaacaacatcaagctcaccgtggtcgtgggggacatcatcggcgtgctggagcagggcaagcgcaccctgacgccccagccgatggagctcaagtacagctggaagacctgggggaaggccaagatcgtcaccgccgagacccagaactccagcttcatcatcgacggccccaacacgcccgagtgcccctccgccagccgggcgtggaacgtgtgggaggtggaggactacgggttcggcgtcttcaccaccaacatctggctgaagctgcgcgaggtgtacacccagctctgcgaccaccggctgatgtccgccgccgtgaaggacgagcgcgccgtccacgccgacatgggctactggatcgagagccagaagaacgggagctggaagctggagaaggcgtccctcatcgaggtgaagacctgcacgtggcccaagagccacaccctgtggtccaacggcgtgctggagagcgacatgatcatccccaagtccctcgccgggcccatcagccagcacaactaccggccgggctaccacacccagaccgccgggccctggcacctgggcaagctggagctcgacttcaactactgcgagggcacgaccgtcgtgatcaccgagaactgcgggacccgcggcccctccctgcggacgaccaccgtgagcgggaagctgatccacgagtggtgctgccgctcctgcaccctgccgcccctgcggtacatgggcgaggacgggtgctggtacggcatggagatccgccccatcagcgagaaggaggagaacatggtcaagtccctggtgagcgccggctccgggaaggtggacaacttcacgatgggcgtcctctgcctggccatcctgttcgaggaggtgatgcgggggaagttcggcaagaagcacatgatcgcgggggtgttcttcaccttcgtcctcctgctgagcggccagatcacctggcgcgacatggcccacaccctcatcatgatcggctccaacgccagcgaccggatggggatgggcgtgacgtacctggccctgatcgccaccttcaagatccagcccttcctcgcgctggggttcttcctgcgcaagctcacctcccgggagaacctgctgctcggcgtgggcctggccatggccaccacgctgcagctccccgaggacatcgagcagatggccaacgggatcgcgctgggcctgatggccctcaagctgatcacccagttcgagacctaccagctgtggaccgccctcatcagcctgacgtgcagcaacaccatcttcaccctgaccgtcgcctggcgcacggccaccctcatcctggcgggggtgtccctgctcccggtctgccagagctccagcatgcggaagaccgactggctgcccatgaccgtggccgccatgggcgtgccgcccctccccctgttcatcttctccctgaaggacacgctgaagcgccgcagctggcccctcaacgagggggtcatggccgtgggcctggtgtccatcctggccagctccctcctgcggaacgacgtccccatggcgggccccctggtggccgggggcctcctgatcgcctgctacgtgatcaccgggaccagcgccgacctgaccgtcgagaaggccgcggacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgccctgctgatcgtgagcggcatcttcccgtactccatccccgccaccctcctggtctggcacacctggcagaagcagacgcagcggagcggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgcggtcctgacctacaacgggaagcgcctggagcccaactgggccagcgtgaagaaggacctcatctcctacggcgggggctggcggctgagcgcccagtggcagaagggggaggaggtgcaggtcatcgccgtggagcccggcaagaaccccaagaacttccagaccatgccgggcaccttccagacgaccaccggggagatcggcgcgatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctcgaggaggagatgttcaagaagcggaacctgaccatcatggacctgcaccccgggtccggcaagacgcgcaagtacctcccggccatcgtgcgggaggcgatcaagcgccggctgcgcaccctgatcctcgcccccacccgggtggtcgccgccgagatggaggaggccctgaaggggctgcccatccgctaccagaccacggcgaccaagagcgagcacaccggccgggagatcgtggacctcatgtgccacgccaccttcacgatgcgcctgctgtcccccgtgcgggtcccgaactacaacctcatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctgcggaagaacgggaagaaggtgatccagctgagccgcaagacgttcgacaccgagtaccagaagaccaagctcaacgactgggacttcgtggtcaccacggacatctccgagatgggcgccaacttcaaggccgaccgggtgatcgacccgcgccggtgcctgaagcccgtgatcctgaccgacggccccgagcgcgtcatcctcgccgggcccatgccggtgaccgcggccagcgccgcccagcggcgcggccgggtggggcgcaacccccagaaggagaacgaccagtacatcttcaccggccagcccctgaacaacgacgaggaccacgcccactggaccgaggcgaagatgctgctcgacaacatcaacacgcccgaggggatcatcccggccctgttcgagcccgagcgggagaagtccgccgccatcgacggcgagtaccgcctgaagggcgagagccggaagaccttcgtcgagctcatgcgccgcggggacctgcccgtgtggctggcgcacaaggtcgcctccgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacgtacagcgacccgctcgccctgaaggagttcaaggacttcgccgcgggccgcaagtccatcgccctggacctcgtgaccgagatcgggcgggtccccagccacctggcccaccgcacccggaacgccctggacaacctcgtgatgctgcacacctccgagcacggcgggaaggcctaccgccacgcggtggaggagctgcccgagacgatggagaccctcctgctgctcggcctgatgatcctgctcaccgggggcgccatgctgttcctgatcagcggcaaggggatcggcaagaccagcatcgggctcatctgcgtcatcgcctccagcggcatgctgtggatggccgagatcccgctgcagtggatcgcctccgcgatcgtgctcgagttcttcatgatggtgctgctgatccccgagcccgagaagcagcggacgccccaggacaaccagctcgcctacgtcgtgatcgggatcctgaccctggccgccatcatcgccgcgaacgagatgggcctcctggagaccaccaagcgcgacctgggcatgagcaaggagccgggggtggtctcccccacgagctacctcgacgtggacctgcaccccgcctccgcctggaccctgtacgccgtggcgaccaccgtcatcacgcccatgctccggcacaccatcgagaacagcaccgccaacgtgtccctggccgccatcgccaaccaggcggtggtcctgatgggcctcgacaaggggtggccgatcagcaagatggacctgggcgtgcccctgctcgccctggggtgctactcccaggtgaaccccctgaccctcacggccgccgtcctgctgctcatcacccactacgccatcatcggccccggcctgcaggcgaaggccacccgcgaggcccagaagcggaccgccgccgggatcatgaagaacccgacggtggacggcatcatgaccatcgacctggaccccgtgatctacgacagcaagttcgagaagcagctcgggcaggtcatgctgctggtgctctgcgcggtgcagctgctgctcatgcgcacctcctgggccctgtgcgaggccctgaccctcgccacgggccccatcaccaccctgtgggagggcagccccgggaagttctggaacaccacgatcgcggtctccatggccaacatcttccggggcagctacctggccggggccggcctcgccttctccatcatgaagtccgtggggaccggcaagcgcggcaccgggtcccagggcgagaccctgggggagaagtggaagaagaagctgaaccagctcagccggaaggagttcgacctgtacaagaagtccggcatcaccgaggtggaccgcacggaggcgaaggaggggctgaagcggggcgagatcacccaccacgccgtctcccgcggcagcgccaagctccagtggttcgtggagcggaacatggtgatcccggaggggcgcgtcatcgacctgggctgcgggcggggcgggtggtcctactactgcgccggcctgaagaaggtgaccgaggtgcgcggctacaccaagggcgggcccgggcacgaggagcccgtccccatgagcacgtacggctggaacatcgtgaagctcatgtccgggaaggacgtgttctacctgccgcccgagaagtgcgacaccctgctgtgcgacatcggcgagagctcccccagccccaccgtcgaggagtcccggaccatccgcgtgctcaagatggtggagccgtggctgaagaacaaccagttctgcatcaaggtcctgaacccctacatgcccacggtgatcgagcacctcgagcgcctgcagcggaagcacggcgggatgctggtgcgcaaccccctcagccggaactccacccacgagatgtactggatcagcaacggcaccgggaacatcgtcgcctccgtgaacatggtgagccgcctgctgctcaaccggttcaccatgacgcaccgccggccgaccatcgagaaggacgtcgacctgggcgcgggcacccgccacgtgaacgccgagcccgagacccccaacatggacgtgatcggggagcggatcaagcgcatcaaggaggagcacaactccacgtggcactacgacgacgagaacccgtacaagacctgggcctaccacggcagctacgaggtcaaggccaccgggtccgccagctccatgatcaacggcgtggtcaagctgctcaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctgtggcgcacgctggggcggaacaagaagccccgcctctgcacccgggaggagttcaccaagaaggtgcgcaccaacgccgccatgggcgcggtgttcacggaggagaaccagtgggacagcgccaaggccgccgtcgaggacgaggacttctggaagctggtggaccgcgagcgggagctgcacaagctcgggaagtgcggctcctgcgtgtacaacatgatggggaagcgcgagaagaagctgggcgagttcggcaaggccaaggggagccgggcgatctggtacatgtggctgggcgcccgctacctcgagttcgaggccctggggttcctgaacgaggaccactggttctcccgggagaacagctactccggcgtcgagggggagggcctccacaagctgggctacatcctgcgcgacatcagcaagatccccgggggcgccatgtacgccgacgacaccgcggggtgggacacccggatcaccgaggacgacctccacaacgaggagaagatcacgcagcagatggacccggagcaccgccagctggccaacgccatcttcaagctgacctaccagaacaaggtggtgaaggtccagcggcccacccccaccggcaccgtgatggacatcatctcccgcaaggaccagcggggcagcggccaggtgggcacgtacgggctcaacaccttcaccaacatggaggcccagctgatccgccagatggagggcgagggggtcctgtccaaggccgacctcgagaacccccacctcccggagaagaagatcacccagtggctggagacgaagggcgtggagcggctcaagcgcatggcgatcagcggcgacgactgcgtggtcaagcccatcgacgaccggttcgccaacgccctgctggccctcaacgacatggggaaggtgcgcaaggacatcccccagtggcagccctccaagggctggcacgactggcagcaggtcccgttctgcagccaccacttccacgagctgatcatgaaggacgggcggaagctggtcgtgccctgccgcccccaggacgagctcatcggccgggcccgcatctcccagggggcgggctggagcctgcgggagaccgcctgcctgggcaaggcctacgcccagatgtggtccctcatgtacttccaccgccgcgacctgcggctggcgagcaacgccatctgctccgccgtgcccgtccactgggtgccgaccagccgcaccacgtggtccatccacgcccaccaccagtggatgaccaccgaggacatgctcaccgtgtggaaccgggtctggatcgaggacaacccctggatggaggacaagacgcccgtgaccacctgggagaacgtgccctacctggggaagcgcgaggaccagtggtgcggcagcctgatcgggctcaccagccgggccacgtgggcgcagaacatcccgaccgccatccagcaggtccgctccctgatcggcaacgaggagttcctggactacatgcccagcatgaagcggttccgcaaggaggaggagtccgagggggccatctggtga

SEQ ID NO: 10184 - RNA, 9873 nt, synthetic construct
  misc_feature 1..9873: note = derived and/or modified CDS sequence (opt1) from DENV-3__FJ562107__SS-prME
  source 1..9873: mol_type = other RNA
accagcctgtgcctcatgatgatcctgcccgcggcgctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtctggttcgtgcccagcatcaaggccggcaacgacatcgcgaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgccgcgtccgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcctacaaggtggcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgccggccgcaagagcatcgcgctggacctggtcaccgagatcgggcgggtgccctcccacctcgcccaccgcacccggaacgccctggacaacctggtgatgctccacaccagcgagcacggcgggaaggcctaccgccacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccaccaagcgcgacctgggcatgtccaaggagccgggggtcgtgagccccacgtcctacctggacgtggacctccaccccgcgagcgcctggaccctgtacgccgtcgccaccaccgtgatcacgcccatgctgcggcacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcgcaccagctgggcgctctgcgaggccctgaccctggccacgggccccatcaccaccctctgggagggctcccccgggaagttctggaacaccacgatcgccgtgagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggccaaggaggggctgaagcggggcgagatcacccaccacgcggtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgccggcacccgccacgtgaacgcggagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgcggagtggctctggcgcacgctggggcggaacaagaagccccgcctgtgcacccgggaggagttcaccaagaaggtgcgcaccaacgccgccatgggcgccgtcttcacggaggagaaccagtgggactccgcgaaggccgccgtggaggacgaggacttctggatcctcgtggaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggccatctccggcgacgactgcgtcgtgaagcccatcgacgaccggttcgcgaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctccgggagaccgcgtgcctgggcaaggcctacgcccagatgtggagcctgatgtacttccaccgccgcgacctccggctggcctccaacgcgatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10185 - RNA, 9873 nt, synthetic construct
  misc_feature 1..9873: note = derived and/or modified CDS sequence (opt1) from DENV-3__FJ547071__SS-prME
  source 1..9873: mol_type = other RNA
accagcctgtgcctcatgatgatcctgcccgcggccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaagacggccgacgtgacctgggaggaggaggcggagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgccatcgcgctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggccatcaagcgccggctccgcaccctgatcctggcgcccacccgggtggtcgccgccgagatggaggaggccctcaaggggctgcccatccgctaccagacgaccgccaccaagtccgagcacaccggccgggagatcgtggacctgatgtgccacgcgacgttcaccatgcgcctcctgagccccgtgcgggtcccgaactacaacctgatcatcatggacgaggcccacttcaccgaccccgcctccatcgccgcccgcgggtacatcagcacccgggtgggcatgggcgaggcggccgccatcttcatgacggccacgccgcccgggaccgcggacgccttcccgcagtccaacgcccccatccaggacgaggagcgcgacatccccgagcgcagctggaactccggcaacgagtggatcaccgacttcgccgggaagacggtgtggttcgtccccagcatcaaggccggcaacgacatcgcgaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgccgcgtccgccgcccagcggcgcggccgggtggggcgcaacccccagaaggagaacgaccagtacatcttcaccggccagcccctcaacaacgacgaggaccacgcccactggacggaggccaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcccacaaggtcgcgagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgccggccgcaagagcatcgcgctggacctggtgaccgagatcgggcgggtcccctcccacctcgcccaccgcacccggaacgccctggacaacctggtgatgctccacacgagcgagcacggcgggaaggcctaccgccacgccgtggaggagctgcccgagaccatggagaccctgctcctgctgggcctcatgatcctgctgaccgggggcgcgatgctgttcctgatcagcggcaaggggatcggcaagacgtccatcgggctgatctgcgtcatcgccagctccggcatgctctggatggccgagatcccgctgcagtggatcgccagcgccatcgtgctggagttcttcatgatggtgctcctgatccccgagcccgagaagcagcggacgccccaggacaaccagctggcgtacgtcgtgatcgggatcctcaccctggccgccatcatcgccgccaacgagatgggcctgctcgagaccacgaagcgcgacctgggcatgtccaaggagccgggggtggtcagccccacctcctacctggacgtggacctccaccccgcgagcgcctggaccctgtacgccgtggccaccacggtcatcacccccatgctgcggcacaccatcgagaactccaccgcgaacgtgagcctcgccgccatcgccaaccaggccgtggtcctgatgggcctggacaaggggtggccgatctccaagatggacctcggcgtgcccctgctggcgctcgggtgctacagccaggtgaaccccctgacgctgaccgccgccgtcctcctgctgatcacccactacgccatcatcggccccggcctccaggccaaggcgacccgcgaggcccagaagcggacggccgccgggatcatgaagaacccgaccgtggacggcatcatgaccatcgacctggaccccgtgatctacgactccaagttcgagaagcagctggggcaggtcatgctcctgatcctgtgcgccgtgcagctcctgctgatgcgcaccagctgggcgctctgcgaggccctgacgctggccaccggccccatcaccaccctctgggagggctcccccgggaagttctggaacacgaccatcgccgtgagcatggcgaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgcggtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcacgatgacccaccgccggccgaccatcgagaaggacgtggacctcggcgccggcacccgccacgtcaacgcggagcccgagacgcccaacatggacgtgatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggccatgaccgacaccacgcccttcgggcagcagcgggtcttcaaggagaaggtggacacccgcaccccgcggagcatgcccggcacccgccgggtgatgggcatcacggcggagtggctctggcgcaccctggggcggaacaagaagccccgcctgtgcacccgggaggagttcaccaagaaggtccgcacgaacgccgccatgggcgccgtgttcaccgaggagaaccagtgggactccgcgaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgccgggtgggacacccggatcacggaggacgacctgcacaacgaggagaagatcacccagcagatggacccggagcaccgccagctcgcgaacgccatcttcaagctgacctaccagaacaaggtcgtgaaggtgcagcggcccacccccaccggcacggtcatggacatcatcagccgcaaggaccagcggggctccggccaggtgggcacctacgggctgaacaccttcaccaacatggaggcccagctcatccgccagatggagggcgagggggtgctgagcaaggccgacctggagaacccccacctcccggagaagaagatcacgcagtggctggagaccaagggcgtcgagcggctgaagcgcatggccatctccggcgacgactgcgtggtgaagcccatcgacgaccggttcgcgaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctccgggagaccgcgtgcctgggcaaggcctacgcccagatgtggagcctgatgtacttccaccgccgcgacctccggctggcctccaacgcgatctgcagcgccgtgcccgtgcactgggtcccgacctcccgcacgacctggagcatccacgcccaccaccagtggatgaccaccgaggacatgctgacggtgtggaaccgggtgtggatcgaggacaacccctggatggaggacaagacccccgtcaccacctgggagaacgtgccctacctcgggaagcgcgaggaccagtggtgcggcagcctgatcgggctgacgtcccgggccacctgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10186 - RNA, 9873 nt, synthetic construct
  misc_feature 1..9873: note = derived and/or modified CDS sequence (opt1) from DENV-3__FJ410176__SS-prME
  source 1..9873: mol_type = other RNA
accagcctgtgcctcatgatgatcctgcccgccgccctggcgttccacctcacctcccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggcagctccctccggaccaccaccgtgagcgggaagctgatccacgagtggtgctgccgctcctgcacgctgccgcccctgcggtacatgggcgaggacgggtgctggtacggcatggagatccgcccgatcagcgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgcgggggtgctgttcaccttcgtcctcctgctgagcggccagatcacctggcgcgacatggcccacacgctcatcatgatcggctccaacgccagcgaccggatggggatgggcgtgacctacctggccctgatcgccaccttcaagatccagcccttcctcgcgctggggttcttcctgcgcaagctcaccagccgggagaacctgctgctcggcgtgggcctggccatggccacgaccctgcagctccccgaggacatcgagcagatggccaacgggatcgcgctgggcctgatggccctcaagctgaccacccagttcgagacgtaccagctgtggaccgccctcatctccctgacctgcagcaacaccatcttcacgctgaccgtcgcctggcgcaccgccaccctcatcctggcgggggtgtccctgctccccgtctgccagagctccagcatgcggaagacggactggctgccgatgaccgtggccgccatgggcgtgccgcccctgcccctcttcatcttctccctgaaggacaccctgaagcgccgcagctggccgctcaacgagggggtcatggccgtgggcctggtgtccatcctggccagctccctcctgcggaacgacgtccccatggcgggccccctggtggccgggggcctcctgatcgcctgctacgtgatcaccgggacgagcgccgacctgaccgtcgagaaggccgcggacgtgacctgggaggaggaggccgagcagaccggcgtgtcccacaacctcatgatcaccgtcgacgacgacgggacgatgcgcatcaaggacgacgagaccgagaacatcctgaccgtgctgctcaagaccgccctgctgatcgtgagcggcatcttcccctactccatcccggccacgctcctggtctggcacacctggcagaagcagacccagcggagcggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacccggggcgcggtcctgacctacaacgggaagcgcctggagccgaactgggccagcgtgaagaaggacctcatctcctacggcgggggctggcggctgagcgcccagtggcagaagggggaggaggtgcaggtcatcgccgtggagcccggcaagaaccccaagaacttccagacgatgcccggcaccttccagaccaccacgggggagatcggcgcgatcgccctggacttcaagccggggaccagcggctcccccatcatcaaccgcgagggcaaggtggtcgggctgtacggcaacggggtggtgaccaagaacggcgggtacgtcagcggcatcgcccagaccaacgccgagcccgacggcccgacgcccgagctcgaggaggagatgttcaagaagcggaacctgaccatcatggacctgcaccccgggtccggcaagacccgcaagtacctccccgccatcgtgcgggaggcgatcaagcgccggctgcgcaccctgatcctcgccccgacgcgggtggtcgccgccgagatggaggaggccctgaaggggctgcccatccgctaccagaccaccgcgaccaagagcgagcacacgggccgggagatcgtggacctcatgtgccacgccaccttcaccatgcgcctgctgtcccccgtgcgggtccccaactacaacctcatcatcatggacgaggcccacttcaccgacccggccagcatcgccgcgcgcgggtacatctccacgcgggtgggcatgggcgaggccgccgccatcttcatgaccgcgacgccgcccgggaccgccgacgccttcccccagagcaacgccccgatccaggacgaggagcgcgacatccccgagcgctcctggaacagcggcaacgagtggatcacggacttcgccgggaagaccgtgtggttcgtcccctccatcaaggcgggcaacgacatcgccaactgcctgcggaagaacgggaagaaggtgatccagctgagccgcaagaccttcgacaccgagtaccagaagacgaagctcaacgactgggacttcgtggtcaccaccgacatctccgagatgggcgccaacttcaaggccgaccgggtgatcgacccccgccggtgcctgaagccggtgatcctgaccgacggccccgagcgcgtcatcctcgccgggcccatgcccgtgaccgcggccagcgccgcccagcggcgcggccgggtggggcgcaacccgcagaaggagaacgaccagtacatcttcacgggccagcccctgaacaacgacgaggaccacgcccactggaccgaggcgaagatgctgctcgacaacatcaacacccccgaggggatcatccccgccctgttcgagccggagcgggagaagtccgccgccatcgacggcgagtaccgcctgaagggcgagagccggaagaccttcgtcgagctcatgcgccgcggggacctgcccgtgtggctggcgcacaaggtcgcctccgagggcatcaagtacacggaccgcaagtggtgcttcgacgggcagcggaacaaccagatcctcgaggagaacatggacgtggagatctggaccaaggagggcgagaagaagaagctgcgcccccggtggctggacgcccgcacctacagcgaccccctcgccctgaaggagttcaaggacttcgccgcgggccgcaagtccatcgccctggacctcgtgaccgagatcgggcgggtcccgagccacctggcccaccgcacgcggaacgccctggacaacctcgtgatgctgcacaccagcgagcacggcgggaaggcctaccgccacgcggtggaggagctgcccgagaccatggagaccctcctgctgctcggcctgatgatcctgctcaccggcggggccatgctgttcctgatctccgggaaggggatcggcaagaccagcatcgggctcatctgcgtcatcgcctccagcggcatgctgtggatggccgagatccccctgcagtggatcgcctccgcgatcgtgctcgagttcttcatgatggtgctgctgatcccggagcccgagaagcagcggacgccccaggacaaccagctcgcctacgtcgtgatcgggatcctgaccctggccgccatcatcgccgcgaacgagatgggcctcctggagacgaccaagcgcgacctgggcatgagcaaggagcccggggtggtctccccgaccagctacctcgacgtggacctgcaccccgcctccgcctggaccctgtacgccgtggcgacgaccgtcatcacccccatgctccggcacaccatcgagaacagcacggccaacgtgtccctggccgccatcgccaaccaggcggtggtcctgatgggcctcgacaaggggtggcccatcagcaagatggacctgggcgtgccgctgctcgccctggggtgctactcccaggtgaaccccctgaccctcaccgccgccgtcctgctgctcatcacccactacgccatcatcggccccggcctgcaggcgaaggccacgcgcgaggcccagaagcggaccgccgccgggatcatgaagaaccccaccgtggacggcatcatgaccatcgacctggacccggtgatctacgacagcaagttcgagaagcagctcgggcaggtcatgctgctggtgctctgcgcggtgcagctgctgctcatgcgcacgtcctgggccctgtgcgaggccctgaccctcgccaccggccccatcaccacgctgtgggagggcagccccgggaagttctggaacaccaccatcgcggtctccatggccaacatcttccggggcagctacctggccggggccggcctcgccttctccatcatgaagtccgtggggaccggcaagcgcggcaccgggagccagggcgagacgctgggggagaagtggaagaagaagctgaaccagctctcccggaaggagttcgacctgtacaagaagtccggcatcaccgaggtggaccgcaccgaggcgaaggaggggctgaagcggggcgagatcacccaccacgccgtctcccgcggcagcgccaagctccagtggttcgtggagcggaacatggtgatccccgaggggcgcgtcatcgacctgggctgcgggcggggcgggtggtcctactactgcgccggcctgaagaaggtgacggaggtgcgcggctacaccaagggcgggccggggcacgaggagcccgtccccatgagcacctacggctggaacatcgtgaagctcatgtccgggaaggacgtgttctacctgcccccggagaagtgcgacaccctgctgtgcgacatcggcgagagctcccccagccccacggtcgaggagtcccggaccatccgcgtgctcaagatggtggagccctggctgaagaacaaccagttctgcatcaaggtcctgaacccgtacatgcccaccgtgatcgagcacctcgagcgcctgcagcggaagcacggcgggatgctggtgcgcaaccccctcagccggaactccacccacgagatgtactggatcagcaacggcacggggaacatcgtcgcctccgtgaacatggtgagccgcctgctgctcaaccggttcaccatgacccaccgccggcccaccatcgagaaggacgtcgacctgggcgcgggcacgcgccacgtgaacgccgagccggagacccccaacatggacgtgatcggggagcggatcaagcgcatcaaggaggagcacaactccacctggcactacgacgacgagaacccctacaagacctgggcctaccacggcagctacgaggtcaaggccacggggtccgccagcagcatgatcaacggcgtggtcaagctgctcaccaagccgtgggacgtggtgcccatggtcacccagatggcgatgaccgacacgacccccttcgggcagcagcgggtgttcaaggagaaggtggacacccgcacgccccggtccatgccgggcacgcgccgggtcatgggcatcaccgccgagtggctgtggcgcaccctggggcggaacaagaagccccgcctctgcacccgggaggagttcacgaagaaggtgcgcaccaacgccgccatgggcgcggtgttcaccgaggagaaccagtgggacagcgccaaggccgccgtcgaggacgaggacttctggaagctggtggaccgcgagcgggagctgcacaagctcgggaagtgcggctcctgcgtgtacaacatgatggggaagcgcgagaagaagctgggcgagttcggcaaggccaaggggagccgggcgatctggtacatgtggctgggcgcccgctacctcgagttcgaggccctggggttcctgaacgaggaccactggttctcccgggagaacagctactccggcgtcgagggggagggcctccacaagctgggctacatcctgcgcgacatcagcaagatccccgggggcgccatgtacgccgacgacaccgcggggtgggacacgcggatcaccgaggacgacctccacaacgaggagaagatcacccagcagatggaccccgagcaccgccagctggccaacgccatcttcaagctgacctaccagaacaaggtggtgaaggtccagcggccgacccccacgggcaccgtgatggacatcatctcccgcaaggaccagcggggcagcggccaggtgggcacctacgggctcaacaccttcacgaacatggaggcccagctgatccgccagatggagggcgagggggtcctgtccaaggccgacctcgagaacccccacctccccgagaagaagatcacccagtggctggagaccaagggcgtggagcggctcaagcgcatggcgatcagcggcgacgactgcgtggtcaagccgatcgacgaccggttcgccaacgccctgctggccctcaacgacatggggaaggtgcgcaaggacatcccccagtggcagccctccaagggctggcacgactggcagcaggtccccttctgcagccaccacttccacgagctgatcatgaaggacgggcggaagctggtcgtgccgtgccgcccccaggacgagctcatcggccgggcccgcatctcccagggggcgggctggagcctgcgggagaccgcctgcctgggcaaggcctacgcccagatgtggtccctcatgtacttccaccgccgcgacctgcggctggcgagcaacgccatctgctccgccgtgcccgtccactgggtgcccacgagccgcaccacctggagcatccacgcccaccaccagtggatgaccacggaggacatgctcaccgtgtggaaccgggtctggatcgaggacaacccgtggatggaggacaagacccccgtgaccacgtgggagaacgtgccctacctggggaagcgcgaggaccagtggtgcggctccctgatcgggctcaccagccgggccacctgggcgcagaacatccccaccgccatccagcaggtccgctccctgatcggcaacgaggagttcctggactacatgccgagcatgaagcggttccgcaaggaggaggagtccgagggggccatctggtga

SEQ ID NO: 10187 - RNA, 9873 nt, synthetic construct
  misc_feature 1..9873: note = derived and/or modified CDS sequence (opt1) from DENV-3__FJ410177__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgggcgggcccagcctccgcaccaccaccgtgtccggcaagctgatccacgagtggtgctgccggagctgcacgctgcccccgctccgctacatgggggaggacggctgctggtacggcatggagatccggcccatctccgagaaggaggagaacatggtcaagagcctggtgtccgccgggagcggcaaggtggacaacttcaccatgggggtcctgtgcctcgccatcctgttcgaggaggtgatgcgcggcaagttcgggaagaagcacatgatcgcgggcgtgttcttcaccttcgtcctgctcctgtccggccagatcacctggcgggacatggcccacacgctgatcatgatcgggagcaacgcctccgaccgcatgggcatgggggtgacctacctcgccctgatcgccaccttcaagatccagcccttcctggcgctcggcttcttcctgcggaagctgaccagccgcgagaacctcctgctgggcgtggggctcgccatggccacgaccctgcagctgcccgaggacatcgagcagatggccaacggcatcgcgctcgggctgatggccctgaagctcaccacccagttcgagacgtaccagctgtggaccgccctgatcagcctgacctgctccaacaccatcttcacgctgaccgtcgcctggcggaccgccaccctgatcctcgcgggcgtgagcctgctgccggtctgccagtccagctccatgcgcaagacggactggctccccatgaccgtggccgccatgggggtgccgcccctcccgctgttcatcttcagcctcaaggacaccctgaagcggcgctcctggcccctgaacgagggcgtcatggccgtgggcctcgtgagcatcctggcctccagcctgctccgcaacgacgtccccatggcggggcccctggtggccggcgggctgctcatcgcctgctacgtgatcaccggcacgtccgccgacctgaccgtcgagaaggccgcggacgtgacctgggaggaggaggccgagcagaccggggtgagccacaacctgatgatcaccgtcgacgacgacggcacgatgcggatcaaggacgacgagaccgagaacatcctcaccgtgctgctgaagaccgccctcctgatcgtgtccggcatcttcccgtacagcatccccgccacgctgctcgtctggcacacctggcagaagcagacccagcgctccggggtgctgtgggacgtgcccagcccgcccgagacccagaaggccgagctggaggagggcgtctaccggatcaagcagcaggggatcttcggcaagacccaggtgggggtgggcgtccagaaggagggcgtgttccacaccatgtggcacgtgacccgcggggcggtcctcacctacaacggcaagcggctggagcccaactgggcctccgtgaagaaggacctgatcagctacgggggcgggtggcgcctctccgcccagtggcagaagggcgaggaggtgcaggtcatcgccgtggagcccggcaagaaccccaagaacttccagacgatgcccgggaccttccagaccaccacgggcgagatcggggcgatcgccctggacttcaagcccggcaccagcggcagccccatcatcaaccgggaggggaaggtggtcggcctgtacgggaacggcgtggtgaccaagaacgggggctacgtctccggcatcgcccagaccaacgccgagccggacgggcccacgcccgagctggaggaggagatgttcaagaagcgcaacctcaccatcatggacctgcaccccggcagcgggaagacccggaagtacctgccggccatcgtgcgcgaggcgatcaagcggcgcctccggaccctgatcctggcccccacgcgcgtggtcgccgccgagatggaggaggccctcaagggcctgcccatccggtaccagaccaccgcgaccaagtccgagcacacggggcgcgagatcgtggacctgatgtgccacgccaccttcaccatgcggctcctgagccccgtgcgcgtcccgaactacaacctgatcatcatggacgaggcccacttcaccgaccccgcctccatcgccgcgcggggctacatcagcacgcgcgtgggcatgggggaggccgccgccatcttcatgaccgcgacgccgcccggcaccgccgacgccttcccgcagtccaacgcccccatccaggacgaggagcgggacatccccgagcgcagctggaactccgggaacgagtggatcacggacttcgccggcaagaccgtgtggttcgtccccagcatcaaggcggggaacgacatcgccaactgcctccgcaagaacggcaagaaggtgatccagctgtcccggaagaccttcgacaccgagtaccagaagacgaagctgaacgactgggacttcgtggtcaccaccgacatcagcgagatgggcgccaacttcaaggccgaccgcgtgatcgacccgcggcgctgcctcaagcccgtgatcctgaccgacgggcccgagcgggtcatcctggccggccccatgccggtgaccgcggcctccgccgcccagcgccgggggcgcgtgggccggaacccccagaaggagaacgaccagtacatcttcacggggcagcccctcaacaacgacgaggaccacgcccactggaccgaggcgaagatgctgctggacaacatcaacacccccgagggcatcatcccggccctcttcgagcccgagcgcgagaagtccgccgccatcgacggcgagtaccggctgaagggggagtcccgcaagaccttcgtcgagctgatgcggcgcggcgacctccccgtgtggctggcgcacaaggtcgccagcgaggggatcaagtacacggaccggaagtggtgcttcgacggccagcgcaacaaccagatcctggaggagaacatggacgtggagatctggaccaaggagggcgagaagaagaagctccggccccgctggctggacgcccggacctactccgacccgctggccctcaaggagttcaaggacttcgccgcggggcgcaagagcatcgccctggacctggtgaccgagatcggccgcgtcccctcccacctcgcccaccggacgcgcaacgccctggacaacctggtgatgctccacaccagcgagcacgggggcaaggcctaccggcacgcggtggaggagctgcccgagaccatggagaccctgctcctgctggggctcatgatcctgctgacgggcggcgccatgctgttcctgatcagcgggaagggcatcgggaagacctccatcggcctgatctgcgtcatcgccagctccgggatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcggcatcctcaccctggccgccatcatcgccgcgaacgagatgggcctgctcgagacgaccaagcgggacctggggatgtccaaggagccgggcgtggtcagccccacctcctacctggacgtggacctccaccccgccagcgcctggaccctgtacgccgtggcgacgaccgtcatcacccccatgctgcgccacaccatcgagaactccacggccaacgtgagcctcgccgccatcgccaaccaggcggtggtcctgatggggctggacaagggctggccgatctccaagatggacctcggggtgcccctgctggccctcggctgctacagccaggtgaaccccctgaccctgaccgccgccgtcctcctgctgatcacccactacgccatcatcggccccgggctccaggcgaaggccacgcgggaggcccagaagcgcaccgccgccggcatcatgaagaacccgaccgtggacgggatcatgaccatcgacctggaccccgtgatctacgactccaagttcgagaagcagctgggccaggtcatgctcctggtgctgtgcgcggtgcagctcctgctgatgcggacgagctgggccctctgcgaggccctgaccctggccaccggccccatcaccacgctctgggaggggtcccccggcaagttctggaacaccaccatcgcggtcagcatggccaacatcttccgcgggtcctacctggccggcgccgggctggccttcagcatcatgaagtccgtgggcaccggcaagcgggggaccggcagccagggggagacgctcggcgagaagtggaagaagaagctgaaccagctgagccgcaaggagttcgacctctacaagaagtccgggatcaccgaggtggaccggaccgaggcgaaggagggcctgaagcgcggcgagatcacccaccacgccgtcagccgggggtccgccaagctgcagtggttcgtggagcgcaacatggtgatcccggagggccgggtcatcgacctcgggtgcggccgcgggggctggagctactactgcgccggcctgaagaaggtgacggaggtgcgggggtacaccaagggcgggcccggccacgaggagcccgtccccatgtccacctacgggtggaacatcgtgaagctgatgagcggcaaggacgtgttctacctcccgcccgagaagtgcgacaccctgctgtgcgacatcggcgagtccagcccctcccccacggtcgaggagagccgcaccatccgggtgctgaagatggtggagccgtggctcaagaacaaccagttctgcatcaaggtcctgaacccctacatgcccaccgtgatcgagcacctggagcgcctccagcgcaagcacgggggcatgctggtgcggaaccccctgtcccgcaacagcacccacgagatgtactggatctccaacgggacgggcaacatcgtcgccagcgtgaacatggtgtcccggctcctgctgaaccgcttcaccatgacccaccggcgcccgaccatcgagaaggacgtcgacctcggcgcggggacgcggcacgtgaacgccgagcccgagacccccaacatggacgtgatcggcgagcgcatcaagcggatcaaggaggagcacaacagcacctggcactacgacgacgagaacccgtacaagacctgggcctaccacgggtcctacgaggtcaaggccacgggcagcgcctccagcatgatcaacggggtggtcaagctgctgaccaagccctgggacgtggtgcccatggtcacccagatggcgatgaccgacacgacccccttcggccagcagcgcgtgttcaaggagaaggtggacacccggaccccgcgcagcatgcccggcacgcggcgcgtcatggggatcaccgccgagtggctctggcggaccctgggccgcaacaagaagccccggctgtgcacccgcgaggagttcacgaagaaggtgcggaccaacgccgccatgggggcggtgttcaccgaggagaaccagtgggactccgccaaggccgccgtcgaggacgaggacttctggaagctcgtggaccgcgagcgcgagctgcacaagctgggcaagtgcgggagctgcgtgtacaacatgatgggcaagcgggagaagaagctcggcgagttcgggaaggccaagggctcccgcgcgatctggtacatgtggctgggggcccggtacctggagttcgaggccctcggcttcctgaacgaggaccactggttcagccgcgagaactcctacagcggggtcgagggcgagggcctgcacaagctcgggtacatcctgcgggacatctccaagatccccggcggggccatgtacgccgacgacaccgcgggctgggacacgcgcatcaccgaggacgacctgcacaacgaggagaagatcacccagcagatggacccggagcaccggcagctcgccaacgccatcttcaagctgacctaccagaacaaggtggtgaaggtccagcgccccacccccacgggcaccgtgatggacatcatcagccggaaggaccagcgcgggtccggccaggtggggacctacggcctgaacaccttcacgaacatggaggcccagctcatccggcagatggagggggagggcgtcctgagcaaggccgacctggagaacccccacctcccggagaagaagatcacccagtggctggagaccaagggcgtggagcgcctgaagcggatggcgatctccggggacgactgcgtggtcaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccggatcagccagggcgcgggctggtccctccgcgagaccgcctgcctggggaaggcctacgcccagatgtggagcctgatgtacttccaccggcgcgacctccgcctggcgtccaacgccatctgcagcgccgtgcccgtccactgggtgccgacgtcccggaccacctggagcatccacgcccaccaccagtggatgaccacggaggacatgctgaccgtgtggaaccgcgtctggatcgaggacaacccctggatggaggacaagacccccgtgaccacgtgggagaacgtgccctacctcggcaagcgggaggaccagtggtgcgggagcctgatcggcctgacctcccgcgccacctgggcgcagaacatcccgaccgccatccagcaggtccggagcctcatcgggaacgaggagttcctggactacatgccctccatgaagcgcttccggaaggaggaggagagcgagggcgccatctggtga

SEQ ID NO: 10188 - RNA, 9873 nt, synthetic construct
  misc_feature 1..9873: note = derived and/or modified CDS sequence (opt1) from DENV-3__FJ547072__SS-prME
  source 1..9873: mol_type = other RNA
accagcctgtgcctcatgatgatcctgcccgcggcgctggcgttccacctcaccagccgggacggcgagccccggatgatcgtggggaagaacgagcgcggccggagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccggctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccgcggcgcccggcgcatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccggagcacgacccgcatggagaacctgctgtggaagcagatcgccaacgagctcaactacatcctgtgggagaacaacatcaagctgaccgtcgtggtgggggacatcatcggcgtcctcgagcagggcaagcggaccctgacgccccagccgatggagctgaagtactcctggaagacctgggggaaggcgaagatcgtgaccgccgagacccagaacagctccttcatcatcgacggccccaacacgcccgagtgccccagcgcctcccgcgcctggaacgtgtgggaggtcgaggactacgggttcggcgtgttcaccaccaacatctggctcaagctgcgggaggtgtacacccagctgtgcgaccaccgcctcatgagcgcggccgtcaaggacgagcgggccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccgcccgggctaccacacccagaccgccgggccctggcacctcggcaagctggagctggacttcaactactgcgagggcacgaccgtggtgatcaccgagaactgcgggacccggggccccagcctccgcacgaccaccgtctccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcgggaaggtcgacaacttcacgatgggcgtgctgtgcctcgccatcctgttcgaggaggtgatgcgcgggaagttcggcaagaagcacatgatcgccggggtcttcttcaccttcgtgctgctcctgtccggccagatcacctggcgggacatggcgcacaccctgatcatgatcggcagcaacgcctccgaccgcatggggatgggcgtgacgtacctcgccctgatcgccaccttcaagatccagcccttcctggccctcgggttcttcctgcggaagctgaccagccgcgagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcggacggccaccctgatcctcgccggggtcagcctgctgccggtgtgccagtccagctccatgcgcaagaccgactggctccccatgaccgtggcggccatgggcgtgccgcccctcccgctgttcatcttcagcctcaaggacacgctgaagcgccggtcctggcccctgaacgagggggtgatggccgtgggcctcgtcagcatcctggcctccagcctgctccgcaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgccaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacctacaacgggaagcggctggagcccaactgggcgtccgtgaagaaggacctgatcagctacggcgggggctggcgcctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgggagggcaaggtcgtggggctgtacggcaacggggtggtcacgaagaacggcgggtacgtgtccggcatcgcccagaccaacgccgagccggacggccccacccccgagctggaggaggagatgttcaagaagcgcaacctcaccatcatggacctgcaccccgggagcggcaagacgcggaagtacctgccggccatcgtgcgcgaggccatcaagcggcgcctccggaccctgatcctggcgcccacccgcgtcgtggccgccgagatggaggaggccctcaaggggctgcccatccggtaccagaccacggccaccaagtccgagcacaccggccgcgagatcgtggacctgatgtgccacgcgaccttcacgatgcggctcctgagccccgtccgcgtgccgaactacaacctgatcatcatggacgaggcccacttcaccgaccccgcctccatcgccgcccgggggtacatcagcacccgcgtgggcatgggcgaggcggccgccatcttcatgaccgccacgccgcccgggaccgcggacgccttcccgcagtccaacgcccccatccaggacgaggagcgcgacatccccgagcggagctggaactccggcaacgagtggatcaccgacttcgccgggaagaccgtctggttcgtgcccagcatcaaggccggcaacgacatcgcgaactgcctccgcaagaacgggaagaaggtgatccagctgtcccggaagacgttcgacaccgagtaccagaagaccaagctgaacgactgggacttcgtcgtgaccacggacatcagcgagatgggcgccaacttcaaggccgaccgcgtgatcgacccgcggcgctgcctcaagcccgtcatcctgaccgacggccccgagcgggtgatcctggccgggcccatgccggtgaccgccgcgtccgccgcccagcgccggggccgcgtcgggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcccacaaggtggcgagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggacttcgccgccggccgcaagagcatcgcgctggacctggtcaccgagatcgggcgcgtgccctcccacctcgcccaccggacccgcaacgccctggacaacctggtgatgctccacaccagcgagcacggcgggaaggcctaccggcacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcgcacgccccaggacaaccagctggcgtacgtggtgatcgggatcctcaccctggccgccatcatcgccgccaacgagatgggcctgctcgagaccaccaagcgggacctgggcatgtccaaggagccgggggtcgtgagccccacgtcctacctggacgtggacctccaccccgcgagcgcctggaccctgtacgccgtcgccaccaccgtgatcacgcccatgctgcgccacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgggaggcccagaagcgcaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcggaccagctgggcgctctgcgaggccctgaccctggccacgggccccatcaccaccctctgggagggctcccccgggaagttctggaacaccacgatcgccgtgagcatggcgaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtcgaccggacggaggccaaggaggggctgaagcgcggcgagatcacccaccacgcggtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccggggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccacggtgatcgagcacctggagcggctccagcgcaagcacggcgggatgctggtccggaaccccctgtcccgcaacagcacccacgagatgtactggatctccaacggcaccgggaacatcgtggccagcgtgaacatggtctcccggctcctgctgaaccgcttcaccatgacgcaccggcgcccgaccatcgagaaggacgtggacctcggcgccggcacccggcacgtgaacgcggagcccgagacccccaacatggacgtcatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggccatgaccgacaccacccccttcgggcagcagcgcgtgttcaaggagaaggtcgacacgcggaccccgcgcagcatgcccggcacccggcgcgtgatgggcatcaccgcggagtggctctggcggacgctggggcgcaacaagaagccccggctgtgcacccgcgaggagttcaccaagaaggtgcgcaccaacgccgccatgggcgccgtcttcacggaggagaaccagtgggactccgcgaaggccgccgtggaggacgaggacttctggatcctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgccgggtgggacacccgcatcaccgaggacgacctgcacaacgaggagaagatcacgcagcagatggacccggagcaccggcagctcgcgaacgccatcttcaagctgacctaccagaacaaggtggtcaaggtgcagcgccccacccccaccggcaccgtgatggacatcatcagccggaaggaccagcgcggctccgggcaggtcggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtggagcgcctgaagcggatggccatctccggcgacgactgcgtcgtgaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagaccgcgtgcctgggcaaggcctacgcccagatgtggagcctgatgtacttccaccgccgggacctccgcctggcctccaacgcgatctgcagcgccgtccccgtgcactgggtgccgacctcccggaccacgtggagcatccacgcccaccaccagtggatgaccaccgaggacatgctgaccgtctggaaccgcgtgtggatcgaggacaacccctggatggaggacaagacgcccgtgaccacctgggagaacgtcccctacctcgggaagcgggaggaccagtggtgcggcagcctgatcgggctgacctcccgcgccacgtgggcccagaacatcccgaccgcgatccagcaggtccggagcctcatcggcaacgaggagttcctggactacatgccctccatgaagcgcttccggaaggaggaggagagcgagggggccatctggtga

SEQ ID NO: 10189 - RNA, 9873 nt, synthetic construct
  misc_feature 1..9873: note = derived and/or modified CDS sequence (opt1) from DENV-3__FJ547073__SS-prME
  source 1..9873: mol_type = other RNA
accagcctgtgcctcatgatgatcctgcccgcggcgctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtctggttcgtgcccagcatcaaggccggcaacgacatcgcgaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgccgcgtccgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcccacaaggtggcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgccggccgcaagagcatcgcgctggacctggtcaccgagatcgggcgggtgccctcccacctcgcccaccgcacccggaacgccctggacaacctggtgatgctccacaccagcgagcacggcgggaaggcctaccgctacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccaccaagcgcgacctgggcatgtccaaggagccgggggtcgtgagccccacgtcctacctggacgtggacctccaccccgcgagcgcctggaccctgtacgccgtcgccaccaccgtgatcacgcccatgctgcggcacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcgcaccagctgggcgctctgcgaggccctgaccctggccacgggccccatcaccaccctctgggagggctcccccgggaagttctggaacaccacgatcgccgtgagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggccaaggaggggctgaagcggggcgagatcacccaccacgcggtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgccggcacccgccacgtgaacgcggagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgcggagtggctctggcgcacgctggggcggaacaagaagccccgcctgtgcacccgggaggagttcaccaagaaggtgcgcaccaacgccgccatgggcgccgtcttcacggaggagaaccagtgggactccgcgaaggccgccgtggaggacgaggacttctggatcctcgtggaccgcgagcgggagctgcacaagctggggaagtgcggcagctgcgtctacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggccatctccggcgacgactgcgtcgtgaagcccatcgacgaccggttcgcgaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggccggctggtccctccgggagaccgcgtgcctgggcaaggcctacgcccagatgtggagcctgatgtacttccaccgccgcgacctccggctggcctccaacgcgatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10190 - RNA, 9873 nt, synthetic construct
  misc_feature 1..9873: note = derived and/or modified CDS sequence (opt1) from DENV-3__FJ547074__SS-prME
  source 1..9873: mol_type = other RNA
accagcctgtgcctcatgatgatcctgcccgcggcgctggcgttccacctcaccagccgggacggggagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtctggttcgtgcccagcatcaaggccggcaacgacatcgcgaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgccgcgtccgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcccacaaggtggcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgccggccgcaagagcatcgcgctggacctggtcaccgagatcgggcgggtgccctcccacctcgcccaccgcacccggaacgccctggacaacctggtgatgctccacaccagcgagcacggcgggaaggcctaccgccacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccaccaagcgcgacctgggcatgtccaaggagccgggggtcgtgagccccacgtcctacctggacgtggacctccaccccgcgagcgcctggaccctgtacgccgtcgccaccaccgtgatcacgcccatgctgcggcacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcgcaccagctgggcgctctgcgaggccctgaccctggccacgggccccatcaccaccctctgggagggctcccccgggaagttctggaacaccacgatcgccgtgagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggccaaggaggggctgaagcggggcgagatcacccaccacgcggtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgtaccgccggccgaccatcgagaaggacgtggtgctcggcgccggcacccgccacgtcaacgcggagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtgaagctgctgaccaagccctgggacgtcgtgcccatggtgacgcagatggccatgaccgacaccacccccttcgggcagcagcgggtcttcaaggagaaggtggacacgcgcaccccgcggagcatgcccggcacccgccgggtgatgggcatcaccgcggagtggctctggcgcacgctggggcggaacaagaagccccgcctgtgcacccgggaggagttcaccaagaaggtccgcaccaacgccgccatgggcgccgtgttcacggaggagaaccagtgggactccgcgaaggccgccgtggaggacgaggacttctggatcctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtcgagcggctgaagcgcatggccatctccggcgacgactgcgtggtgaagcccatcgacgaccggttcgcgaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctccgggagaccgcgtgcctgggcaaggcctacgcccagatgtggagcctgatgtacttccaccgccgcgacctccggctggcctccaacgcgatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcccagaacatcccgaccgcgatccagcaggtccgcagcctcatcggcaacgaggagttcctggactacatgccctccatgaagcggttccgcaaggaggaggagagcgagggggccatctggtga

SEQ ID NO: 10191 - RNA, 9873 nt, synthetic construct
  misc_feature 1..9873: note = derived and/or modified CDS sequence (opt1) from DENV-3__FJ547075__SS-prME
  source 1..9873: mol_type = other RNA
accagcctgtgcctcatgatgatcctgcccgcggcgctggcgttccacctcaccagccgggacggcgagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagagcgacggcccgacccccgagctggaggaggagatgttcaagaagcggaacctcaccatcatggacctgcaccccgggtccggcaagacgcgcaagtacctgcccgccatcgtgcgggaggccatcaagcgccggctccgcaccctgatcctggcgccgacccgggtcgtggccgccgagatggaggaggccctcaaggggctgcccatccgctaccagaccacggccaccaagagcgagcacaccggccgggagatcgtggacctgatgtgccacgcgaccttcacgatgcgcctcctgtcccccgtccgggtgcccaactacaacctgatcatcatggacgaggcccacttcaccgacccggccagcatcgccgcccgcgggtacatctccacccgggtgggcatgggcgaggcggccgccatcttcatgaccgccacgccgcccgggaccgcggacgccttcccccagagcaacgccccgatccaggacgaggagcgcgacatccccgagcgctcctggaacagcggcaacgagtggatcaccgacttcgccgggaagaccgtctggttcgtgccctccatcaaggccggcaacgacatcgcgaactgcctccggaagaacgggaagaaggtgatccagctgagccgcaagacgttcgacaccgagtaccagaagaccaagctgaacgactgggacttcgtcgtgaccacggacatctccgagatgggcgccaacttcaaggccgaccgggtgatcgacccccgccggtgcctcaagccggtcatcctgaccgacggccccgagcgcgtgatcctggccgggcccatgcccgtgaccgccgcgagcgccgcccagcggcgcggccgggtcgggcgcaacccgcagaaggagaacgaccagtacatcttcaccggccagcccctcaacaacgacgaggaccacgcccactggaccgaggccaagatgctgctggacaacatcaacacgcccgaggggatcatccccgccctcttcgagccggagcgggagaagtccgccgccatcgacggcgagtaccgcctgaagggcgagagccggaagaccttcgtggagctgatgcgccgcggggacctccccgtctggctggcccacaaggtggcgtccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgaccccctggccctcaaggagttcaaggacttcgccgccggccgcaagtccatcgcgctggacctggtcaccgagatcgggcgggtgccgagccacctcgcccaccgcacccggaacgccctggacaacctggtgatgctccacaccagcgagcacggcgggaaggcctaccgccacgccgtcgaggagctgcccgagacgatggagaccctgctcctgctgggcctcatgatcctgctgaccgggggcgcgatgctgttcctgatctccggcaaggggatcggcaagaccagcatcgggctgatctgcgtgatcgcctccagcggcatgctctggatggccgagatccccctgcagtggatcgcctccgccatcgtgctggagttcttcatgatggtcctcctgatcccggagcccgagaagcagcggacgccccaggacaaccagctggcgtacgtggtgatcgggatcctcaccctggccgccatcatcgccgccaacgagatgggcctgctcgagaccaccaagcgcgacctgggcatgagcaaggagcccggggtcgtgtccccgacgagctacctggacgtggacctccaccccgcgtccgcctggaccctgtacgccgtcgccaccaccgtgatcacgcccatgctgcggcacaccatcgagaacagcaccgcgaacgtgtccctcgccgccatcgccaaccaggccgtcgtgctgatgggcctggacaaggggtggcccatcagcaagatggacctcggcgtgccgctgctggcgctcgggtgctactcccaggtcaaccccctgaccctgacggccgccgtgctcctgctgatcacccactacgccatcatcggccccggcctccaggccaaggcgacccgcgaggcccagaagcggaccgccgccgggatcatgaagaaccccacggtggacggcatcatgaccatcgacctggacccggtcatctacgacagcaagttcgagaagcagctgggccaggtgatgctcctggtgctgtgcgccgtccagctcctgctgatgcgcacctcctgggcgctctgcgaggccctgaccctggccacgggccccatcaccaccctctgggagggcagccccgggaagttctggaacaccacgatcgccgtgtccatggcgaacatcttccggggcagctacctggccggggccggcctggccttctccatcatgaagtccgtggggaccggcaagcgcggcaccgggagccagggcgagaccctcggggagaagtggaagaagaagctgaaccagctgtcccggaaggagttcgacctctacaagaagtccggcatcaccgaggtcgaccgcacggaggccaaggaggggctgaagcggggcgagatcacccaccacgcggtgtcccgcggcagcgccaagctgcagtggttcgtggagcggaacatggtcatccccgaggggcgcgtgatcgacctcggctgcgggcggggcgggtggtcctactactgcgccggcctgaagaaggtgaccgaggtccgcggctacaccaagggcgggccggggcacgaggagcccgtgcccatgagcacgtacggctggaacatcgtgaagctgatgtccgggaaggacgtcttctacctcccgcccgagaagtgcgacaccctgctgtgcgacatcggcgagagctcccccagccccaccgtggaggagtcccggaccatccgcgtgctgaagatggtcgagccctggctcaagaacaaccagttctgcatcaaggtgctgaacccctacatgcccacggtgatcgagcacctggagcgcctccagcggaagcacggcgggatgctggtccgcaaccccctgagccggaactccacccacgagatgtactggatcagcaacggcaccgggaacatcgtggcctccgtgaacatggtcagccgcctcctgctgaaccggttcaccatgacgcaccgccggcccaccatcgagaaggacgtggacctcggcgccggcacccgccacgtgaacgcggagccggagacccccaacatggacgtcatcggggagcggatcaagcgcatcaaggaggagcacaactccacgtggcactacgacgacgagaacccctacaagacctgggcctaccacggcagctacgaggtgaaggccaccgggtccgccagcagcatgatcaacggcgtcgtgaagctgctgaccaagccgtgggacgtggtccccatggtgacgcagatggccatgaccgacaccacccccttcgggcagcagcgggtgttcaaggagaaggtcgacacgcgcacgccccggtccatgccgggcacccgccgggtgatgggcatcaccgcggagtggctctggcgcacgctggggcggaacaagaagccccgcctgtgcacccgggaggagttcaccaagaaggtgcgcaccaacgccgccatgggcgccgtcttcacggaggagaaccagtgggacagcgcgaaggccgccgtggaggacgaggacttctggatcctcgtggaccgcgagcgggagctgcacaagctggggaagtgcggctcctgcgtctacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgccgggtgggacacccggatcaccgaggacgacctgcacaacgaggagaagatcacgcagcagatggaccccgagcaccgccagctcgcgaacgccatcttcaagctgacctaccagaacaaggtggtcaaggtgcagcggccgacccccaccggcaccgtgatggacatcatctcccgcaaggaccagcggggcagcgggcaggtcggcacgtacgggctgaacaccttcaccaacatggaggcccagctcatccgccagatggagggcgagggggtgctgtccaaggccgacctggagaacccccacctccccgagaagaagatcacccagtggctggagacgaagggcgtggagcggctgaagcgcatggccatcagcggcgacgactgcgtcgtgaagccgatcgacgaccggttcgcgaacgccctcctggccctgaacgacatggggaaggtgcgcaaggacatcccccagtggcagccctccaagggctggcacgactggcagcaggtccccttctgcagccaccacttccacgagctcatcatgaaggacgggcggaagctggtggtgccgtgccgcccccaggacgagctgatcggccgggcccgcatctcccagggggccggctggagcctccgggagaccgcgtgcctgggcaaggcctacgcccagatgtggtccctgatgtacttccaccgccgcgacctccggctggccagcaacgcgatctgctccgccgtccccgtgcactgggtgcccaccagccgcaccacgtggagcatccacgcccaccaccagtggatgaccaccgaggacatgctgaccgtctggaaccgggtgtggatcgaggacaacccgtggatggaggacaagacgcccgtgaccacctgggagaacgtcccctacctcgggaagcgcgaggaccagtggtgcggctccctgatcgggctgaccagccgggccacgtgggcccagaacatccccaccgcgatccagcaggtccgctccctcatcggcaacgaggagttcctggactacatgccgagcatgaagcggttccgcaaggaggaggagtccgagggggccatctggtga

SEQ ID NO: 10192 - RNA, 9873 nt, synthetic construct
  misc_feature 1..9873: note = derived and/or modified CDS sequence (opt1) from DENV-3__FJ547076__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccgtctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacaccagcgagcacggcgggaaggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgcgggcacccgccacgtgaacgccgagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggcgatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgggaggagttcaccaagaaggtgcgcaccaacgccgccatgggcgcggtcttcacggaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10193 - RNA, 9873 nt, synthetic construct
  misc_feature 1..9873: note = derived and/or modified CDS sequence (opt1) from DENV-3__FJ547077__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatgaccgtcgccgccatgggcgtgccgcccctcccgctgttcatcttcagcctcaaggacacgctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacgtcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgcggccggccgcaagagcatcgccctggacctggtgaccgagatcgggcgggtgccctcccacctcgcccaccgcacccggaacgccctggacaacctggtcatgctccacaccagcgagcacggcgggaaggcgtaccgccacgccgtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccaccatcgcggccaacgagatgggcctgctcgagaccacgaagcgcgacctgggcatgtccaaggagccgggggtggtgagccccacctcctacctggacgtcgacctccaccccgccagcgcctggaccctgtacgcggtggccaccacggtgatcacccccatgctgcggcacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgacgctgaccgccgccgtgctcctgctgatcacccactacgcgatcatcggccccggcctccaggccaaggccacccgcgaggcccagaagcggacggccgcggggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcgcaccagctgggccctctgcgaggccctgacgctggcgaccggccccatcaccaccctctgggagggctcccccgggaagttctggaacacgaccatcgccgtgagcatggccaacatcttccggggctcctacctggccggggccggcctggcgttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggccaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggcgagcgtcaacatggtgtcccgcctcctgctgaaccggttcacgatgacccaccgccggccgaccatcgagaaggacgtggacctcggcgccggcacccgccacgtcaacgccgagcccgagacgcccaacatggacgtgatcggggagcggatcaagcgcatcaaggaggagcacaacagcacctggcactacgacgacgagaacccgtacaagacctgggcctaccacggctcctacgaggtgaaggccaccgggagcgcgtccagcatgatcaacggcgtcgtgaagctgctgacgaagccctgggacgtcgtgcccatggtgacccagatggccatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgggaggagttcaccaagaaggtccgcacgaacgccgcgatgggcgccgtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatcagccgcaaggaccagcggggctccggccaggtgggcacctacgggctgaacaccttcaccaacatggaggcccagctcatccgccagatggagggcgagggggtgctgagcaaggcggacctggagaacccccacctcccggagaagaagatcacgcagtggctggagaccaagggcgtcgagcggctgaagcgcatggccatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcgcgcatcagccagggggccggctggtccctccgggagaccgcctgcctgggcaaggcctacgcgcagatgtggaacctgatgtacttccaccgccgcgacctccggctggccagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcgggaagcgcgaggaccagtggtgcggcagcctgatcgggctgacgagccgggcgacctgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 10194 - RNA, 9873 nt, synthetic construct
  misc_feature 1..9873: note = derived and/or modified CDS sequence (opt1) from DENV-3__FJ547078__SS-prME
  source 1..9873: mol_type = other RNA
accagcctctgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctggatcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcgcacaacggccgcctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggccgacatggggtgcgtcatcaactggaagggcaaggagctgaagtgcggcagcgggatcttcgtgacgaacgaggtgcacacctggaccgagcagtacaagttccaggcggactcccccaagcgcctcgccaccgccatcgccggcgcctgggagaacggggtctgcggcatccgcagcacgacccggatggagaacctgctgtggaagcagatcgcgaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgccgacatgggctactggatcgagagccagaagaacgggtcctggaagctggagaaggcgagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcacgatgggcgtgctgtgcctcgccatcctgttcgaggaggtcatgcgggggaagttcggcaagaagcacatgatcgcgggggtgttcttcaccttcgtgctgctcctgtccggccagatcacctggcgcgacatggcccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagatctaccagctgtggaccgccctgatcagcctgacctgctccaacacgatcttcaccctgaccgtggcctggcgcaccgccacgctgatcctcgcgggggtcagcctgctgccggtgtgccagtccagctccatgcggaagaccgactggctccccatgaccgtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcacggggacctccgccgacctgaccgtggagaaggccgcggacgtcacctgggaggaggaggccgagcagacgggcgtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgcggtgctcacgtacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagaccacgaccggggagatcggcgcgatcgccctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtccgggaggcgatcaagcgccggctccgcacgctgatcctggcccccacccgggtggtggccgccgagatggaggaggccctcaaggggctgcccatccgctaccagaccaccgcgacgaagtccgagcacaccggccgggagatcgtcgacctgatgtgccacgccaccttcaccatgcgcctcctgagccccgtgcgggtgccgaactacaacctgatcatcatggacgaggcccacttcacggaccccgcctccatcgccgcgcgcgggtacatcagcacccgggtcggcatgggcgaggccgccgccatcttcatgaccgcgacgccgcccgggacggccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgccgcgggccgcaagagcatcgccctggacctggtgacggagatcgggcgggtgccctcccacctcgcccaccgcacccggaacgccctggacaacctggtcatgctccacaccagcgagcacggcgggaaggcctaccgccacgcggtggaggagctgcccgagaccatggagacgctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcacgctggccgccatcatcgccgcgaacgagatgggcctgctcgagaccaccaagcgcgacctgggcatgtccaaggagccgggggtggtgagccccacctcctacctggacgtcgacctccaccccgccagcgcctggacgctgtacgccgtggcgaccaccgtgatcacccccatgctgcggcacacgatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgaccgccgccgtgctcctgctgatcacgcactacgccatcatcggccccggcctccaggcgaaggccacccgcgaggcccagaagcggaccgccgccgggatcatgaagaacccgaccgtcgacggcatcatgacgatcgacctggaccccgtgatctacgactccaagttcgagaagcagctgggccaggtgatgctcctggtcctgtgcgcggtgcagctcctgctgatgcgcaccagctgggccctctgcgaggccctgaccctggccaccggccccatcacgaccctctgggagggctcccccgggaagttctggaacaccaccatcgcggtgagcatggccaacatcttccggggctcctacctggccggggccggcctggccttcagcatcatgaagtccgtcgggacgggcaagcgcggcaccgggagccagggcgagaccctcggggagaagtggaagaagaagctgaaccagctgagccggaaggagttcgacctctacaagaagtccggcatcaccgaggtggaccgcaccgaggcgaaggaggggctgaagcggggcgagatcacgcaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgcgggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtcgtgcccatggtgacccagatggcgatgacggacaccacccccttcgggcagcagcgggtcttcaaggagaaggtggacacccgcacgcccaagagcatgcccggcacccggcgcgtgatgggcatcaccgccgagtggctctggcggaccctggggcgcaacaagaagccccggctgtgcacgcgcgaggagttcaccaagaaggtccggaccaacgccgccatgggcgcggtgttcaccgaggagaaccagtgggactccgccaaggccgccgtggaggacgaggacttctggaagctcgtcgaccgcgagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacacggcggggtgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggccgacctggagaacccccacctcccggagaagaagatcacccagtggctggagaccaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctccgcgagacggcctgcctgggcaaggcctacgcccagatgtggagcctgatgtacttccaccggcgcgacctccgcctggcgtccaacgccatctgcagcgccgtgcccgtgcactgggtcccgacctcccggaccacctggagcatccacgcccaccaccagtggatgacgaccgaggacatgctgaccgtgtggaaccgcgtgtggatcgaggacaacccctggatggaggacaagacccccgtcacgacctgggagaacgtgccctacctcgggaagcgggaggaccagtggtgcggcagcctgatcgggctgacctcccgcgccacctgggcgcagaacatcccgacggccatccagcaggtccggagcctcatcggcaacgaggagttcctggactacatgccctccatgaagcgcttccggaaggaggaggagagcgagggggccatctggtga

SEQ ID NO: 10195 - RNA, 9873 nt, synthetic construct
  misc_feature 1..9873: note = derived and/or modified CDS sequence (opt1) from DENV-3__FJ547079__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcacaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10196 - RNA, 9873 nt, synthetic construct
  misc_feature 1..9873: note = derived and/or modified CDS sequence (opt1) from DENV-3__FJ547080__SS-prME
  source 1..9873: mol_type = other RNA
accagcctgtgcctcatgatgatcctgcccgcggcgctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagcacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacgtggccgaagtcccacaccctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtcgacaacttcacgatgggcgtgctgtgcctcgccatcctgttcgaggaggtgatgcgggggaagttcggcaagaagcacatgatcgccggggtcttcttcaccttcgtgctgctcctgtccggccagatcacctggcgcgacatggcgcacaccctgatcatgatcggcagcaacgcctccgaccggatggggatgggcgtgacgtacctcgccctgatcgccaccttcaagatccagcccttcctggccctcgggttcttcctgcgcaagctgaccagccgggagaacctcctgctgggcgtcggcctcgcgatggccaccacgctgcagctgcccgaggacatcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtcagcctgctgccggtgtgccagtccagctccatgcggaagaccgactggctccccatgaccgtggcggccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggccggccccctggtggccggcgggctgctcatcgcctgctacgtcatcaccgggacctccgccgacctgaccgtggagaaggccgccgacgtgacgtgggaggaggaggcggagcagaccggggtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgccgtgctcacctacaacgggaagcgcctggagcccaactgggcgtccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgccatcgcgctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggccatcaagcgccggctccgcaccctgatcctggcgcccacccgggtcgtggccgccgagatggaggaggccctcaaggggctgcccatccgctaccagaccacggccaccaagtccgagcacaccggccgggagatcgtggacctgatgtgccacgcgaccttcacgatgcgcctcctgagccccgtccgggtgccgaactacaacctgatcatcatggacgaggcccacttcaccgaccccgcctccatcgccgcccgcgggtacatcagcacccgggtgggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcaccgacttcgccgggaagaccgtctggttcgtgcccagcatcaaggccggcaacgacatcgcgaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgccgcgtccgccgcccagcggcgcggccgggtcgggcgcaacccccggaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcccacaaggtggcgagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggacttcgccgccggccgcaagagcatcgcgctggacctggtcaccgagatcgggcgcgtgccctcccacctcgcccaccggacccgcaacgccctggacaacctggtgatgctccacaccagcgagcacggcgggaaggcctaccggcacgccgtcgaggagctgcccgagacgatggagaccctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcgcacgccccaggacaaccagctggcgtacgtggtgatcgggatcctcaccctggccgccatcatcgccgccaacgagatgggcctgctcgagaccaccaagcgggacctgggcatgtccaaggagccgggggtcgtgagccccacgtcctacctggacgtggacctccaccccgcgagcgcctggaccctgtacgccgtcgccaccaccgtgatcacgcccatgctgcgccacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgacggccgccgtgctcctgctgatcacccactacgccatcatcggccccggcctccaggccaaggcgacccgggaggcccagaagcgcaccgccgccgggatcatgaagaacccgacggtggacggcatcatgaccatcgacctggaccccgtcatctacgactccaagttcgagaagcagctgggccaggtgatgctcctggtgctgtgcgccgtccagctcctgctgatgcggaccagctgggcgctctgcgaggccctgaccctggccacgggccccatcaccaccctctgggagggctcccccgggaagttctggaacaccacgatcgccgtgagcatggcgaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtcgaccggacggaggccaaggaggggctgaagcgcggcgagatcacccaccacgcggtgagccggggctccgccaagctgcagtggttcgtggagcgcaacatggtcatcccggaggggcgggtgatcgacctcggctgcgggcgcggcgggtggagctactactgcgccggcctgaagaaggtgaccgaggtccggggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccgcaccatccgcgtgctgaagatggtcgagccgtggctcaagaacaaccagttctgcatcaaggtgctgaacccctacatgcccacggtgatcgagcacctggagcggctccagcgcaagcacggcgggatgctggtccggaaccccctgtcccgcaacagcacccacgagatgtactggatctccaacggcaccgggaacatcgtggccagcgtgaacatggtctcccggctcctgctgaaccgcttcaccatgacgcaccggcgcccgaccatcgagaaggacgtggacctcggcgccggcacccggcacgtgaacgcggagcccgagacccccaacatggacgtcatcggggagcgcatcaagcggatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggccatgaccgacaccacccccttcgggcagcagcgcgtgttcaaggagaaggtcgacacgcggaccccgcgcagcatgcccggcacccggcgcgtgatgggcatcaccgcggagtggctctggcggacgctggggcgcaacaagaagccccggctgtgcacccgcgaggagttcaccaagaaggtgcgcaccaacgccgccatgggcgccgtcttcacggaggagaaccagtgggactccgcgaaggccgccgtggaggacgaggacttctggatcctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgccgggtgggacacccgcatcaccgaggacgacctgcacaacgaggagaagatcacgcagcagatggacccggagcaccggcagctcgcgaacgccatcttcaagctgacctaccagaacaaggtggtcaaggtgcagcgccccacccccaccggcaccgtgatggacatcatcagccggaaggaccagcgcggctccgggcaggtcggcacgtacgggctgaacaccttcaccaacatggaggcccagctcatccggcagatggagggcgagggggtgctgagcaaggccgacctggagaacccccacctcccggagaagaagatcacccagtggctggagacgaagggcgtggagcgcctgaagcggatggccatctccggcgacgactgcgtcgtgaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagaccgcgtgcctgggcaaggcctacgcccagatgtggagcctgatgtacttccaccgccgggacctccgcctggcctccaacgcgatctgcagcgccgtccccgtgcactgggtgccgacctcccggaccacgtggagcatccacgcccaccaccagtggatgaccaccgaggacatgctgaccgtctggaaccgcgtgtggatcgaggacaacccctggatggaggacaagacgcccgtgaccacctgggagaacgtcccctacctcgggaagcgggaggaccagtggtgcggcagcctgatcgggctgacctcccgcgccacgtgggcccagaacatcccgaccgcgatccagcaggtccggagcctcatcggcaacgaggagttcctggactacatgccctccatgaagcgcttccggaaggaggaggagagcgagggggccatctggtga

SEQ ID NO: 10197 - RNA, 9873 nt, synthetic construct
  misc_feature 1..9873: note = derived and/or modified CDS sequence (opt1) from DENV-3__FJ547081__SS-prME
  source 1..9873: mol_type = other RNA
accagcctctgcctcatgatgatcctccccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcagcggccacctgaagtgccggctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgtcccgtgcaagatccccttcagcaccgaggacgggcagggcaaggcccacaacggccgcctgatcacggcgaaccccgtggtgaccaagaaggaggagcccgtcaacatcgaggccgagccgcccttcggggagtccaacatcgtgatcggcatcggggacaacgccctgaagatcaactggtacaagaagggcagctccatcgggaagatgttcgaggccaccgcgcggggcgcccgccggatggccatcctgggcgacaccgcctgggacttcgggagcgtgggcggggtcctcaactccctgggcaagatggtgcaccagatcttcgggagcgcctacacggcgctgttctccggcgtgagctgggtcatgaagatcggcatcggggtgctcctgacctggatcggcctgaactccaagaacaccagcatgtccttcagctgcatcgccatcgggatcatcaccctctacctgggcgccgtggtccaggccgacatggggtgcgtgatcaactggaagggcaaggagctgaagtgcggctccgggatcttcgtgacgaacgaggtccacacctggaccgagcagtacaagttccaggccgacagccccaagcgcctcgcgaccgccatcgccggcgcctgggagaacggggtgtgcggcatccgctccacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtacagctggaagacctgggggaaggcgaagatcgtcaccgccgagacccagaactccagcttcatcatcgacggccccaacacgcccgagtgcccctccgccagccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagtcccagaagaacgggagctggaagctggagaaggcctccctgatcgaggtgaagacctgcacgtggcccaagtcccacaccctctggtccaacggcgtgctggagagcgacatgatcatccccaagtccctggcggggcccatcagccagcacaactaccggccgggctaccacacccagaccgccgggccctggcacctcggcaagctggagctggacttcaactactgcgagggcacgaccgtcgtgatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccgggaaggtggacaacttcacgatgggcgtcctgtgcctcgccatcctgttcgaggaggtgatgcgggggaagttcggcaagaagcacatgatcgccggggtgttcttcaccttcgtcctgctcctgagcggccagatcacctggcgcgacatggcgcacaccctgatcatgatcggctccaacgccagcgaccggatggggatgggcgtgacgtacctcgccctgatcgccaccttcaagatccagcccttcctggccctcgggttcttcctgcgcaagctgaccagccgggagaacctcctgctgggcgtgggcctcgcgatggccaccacgctgcagctgcccgaggacatcgagcagatggccaacgggatcgccctcggcctgatgaccctgaagctcatcacccagttcgagacctaccagctgtggacggcgctgatctccctgacctgcagcaacaccatcttcaccctgacggtcgcctggcgcaccgccaccctgatcctcgccggggtgtccctgctgccggtctgccagagctccagcatgcggaagaccgactggctccccatgacggtggccgcgatgggcgtgccgcccctcccgctgttcatcttctccctcaaggacaccctgaagcgccgcagctggcccctgaacgagggggtcatggccgtgggcctcgtgtccatcctggccagctccctgctccggaacgacgtccccatggccggccccctggtggccgggggcctgctcatcgcgtgctacgtgatcaccgggaccagcgccgacctgacggtcgagaaggccgccgacgtgacctgggaggaggaggccgagcagaccggcgtgtcccacaacctgatgatcaccgtcgacgacgacgggaccatgcgcatcaaggacgacgagacggagaacatcctcaccgtgctgctgaagaccgcgctcctgatcgtgagcggcatcttcccgtactccatccccgccaccctgctcgtctggcacacgtggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgccgtcctcacctacaacgggaagcgcctggagcccaactgggccagcgtgaagaaggacctgatctcctacggcgggggctggcggctcagcgcgcagtggcagaagggggaggaggtgcaggtcatcgccgtggagcccggcaagaaccccaagaacttccagaccatgcccggcacgttccagaccaccaccggggagatcggcgccatcgccctggacttcaagcccgggacgagcggctcccccatcatcaaccgcgagggcaaggtggtcgggctgtacggcaacggggtggtgaccaagaacggcgggtacgtcagcggcatcgcgcagaccaacgccgagccggacggccccacccccgagctggaggaggagatgttcaagaagcggaacctcacgatcatggacctgcaccccgggtccggcaagacccgcaagtacctgccggccatcgtgcgggaggccatcaagcgccggctccgcaccctgatcctggcccccacccgggtggtcgcggccgagatggaggaggccctcaaggggctgcccatccgctaccagacgaccgccaccaagagcgagcacaccggccgggagatcgtggacctgatgtgccacgccacgttcaccatgcgcctcctgtcccccgtgcgggtcccgaactacaacctgatcatcatggacgaggcgcacttcaccgaccccgccagcatcgccgcccgcgggtacatctccacccgggtgggcatgggcgaggccgcggccatcttcatgacggccacgccgcccgggaccgccgacgcgttcccgcagagcaacgcccccatccaggacgaggagcgcgacatccccgagcgctcctggaacagcggcaacgagtggatcaccgacttcgccgggaagacggtgtggttcgtcccctccatcaaggccggcaacgacatcgccaactgcctccggaagaacgggaagaaggtgatccagctgagccgcaagaccttcgacaccgagtaccagaagaccaagctgaacgactgggacttcgtggtcacgaccgacatctccgagatgggcgcgaacttcaaggccgaccgggtgatcgacccgcgccggtgcctcaagcccgtgatcctgaccgacggccccgagcgcgtcatcctggccgggcccatgccggtgaccgccgccagcgcggcccagcggcgcggccgggtggggcgcaacccccagaaggagaacgaccagtacatcttcaccggccagcccctcaacaacgacgaggaccacgcccactggacggaggccaagatgctgctggacaacatcaacacccccgaggggatcatcccggccctcttcgagcccgagcgggagaagtccgcggccatcgacggcgagtaccgcctgaagggcgagagccggaagaccttcgtcgagctgatgcgccgcggggacctccccgtgtggctggcccacaaggtcgcctccgagggcatcaagtacgcggaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggacttcgccgccggccgcaagtccatcgcgctggacctggtgaccgagatcgggcgggtccccagccacctcgcccaccgcacccggaacgccctggacaacctggtgatgctccacaccagcgagcacggcgggaaggcctaccgccacgccgtggaggagctgcccgagacgatggagaccctgctcctgctgggcctcatgatcctgctgaccgggggcgcgatgctgttcctgatctccggcaaggggatcggcaagaccagcatcgggctgatctgcgtcatcgcctccagcggcatgctctggatggccgagatcccgctgcagtggatcgcctccgccatcgtgctggagttcttcatgatggtgctcctgatccccgagcccgagaagcagcggacgccccaggacaaccagctggcgtacgtcgtgatcgggatcctcaccctggccgccatcatcgccgccaacgagatgggcctgctcgagaccaccaagcgcgacctgggcatgagcaaggagccgggggtggtctccagcacgtcctacctggacgtggacctccaccccgcgagcgcctggaccctgtacgccgtggccaccaccgtcatcacgcccatgctgcggcacaccatcgagaactccaccgcgaacgtgagcctcgccgccatcgccaaccaggccgtggtcctgatgggcctggacaaggggtggcccatctccaagatggacctcggcgtgccgctgctggcgctcgggtgctacagccaggtgaaccccctgaccctgacggccgccgtcctcctgctgatcacccactacgccatcatcggccccggcctccaggccaaggcgacccgcgaggcccagaagcggaccgccgccgggatcatgaagaaccccacggtggacggcatcatgaccatcgacctggacccggtgatctacgactccaagttcgagaagcagctggggcaggtcatgctcctggtgctgtgcgccgtgcagctcctgctgatgcgcaccagctgggcgctctgcgaggccctgaccctggccacgggccccatcaccaccctctgggagggctcccccgggaagttctggaacaccacgatcgccgtcagcatggcgaacatcttccggggctcctacctggccggggccggcctggccttcagcatcatgaagtccgtggggaccggcaagcgcggcaccgggtcccagggcgagaccctcggggagaagtggaagaagaagctgaaccagctgagccggaaggagttcgacctctacaagaagtccggcatcaccgaggtggaccgcacggaggccaaggaggggctgaagcggggcgagatcacccaccacgcggtcagccgcggctccgccaagctgcagtggttcgtggagcggaacatggtgatccccgaggggcgcgtcatcgacctcggctgcgggcggggcgggtggagctactactgcgccggcctgaagaaggtgaccgaggtgcgcggctacaccaagggcgggccggggcacgaggagcccgtccccatgtccacgtacggctggaacatcgtgaagctgatgagcgggaaggacgtgttctacctgcccccggagaagtgcgacaccctgctgtgcgacatcggcgagtccagcccctcccccaccgtcgaggagagccggaccatccgcgtgctgaagatggtggagccctggctcaagaacaaccagttctgcatcaaggtcctgaacccgtacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggcccaccatcgagaaggacgtcgacctcggcgccggcacccgccacgtgaacgcggagccggagacccccaacatggacgtgatcggggagcggatcaagcgcatcaaggaggagcacaacagcacgtggcactacgacgacgagaacccctacaagacctgggcctaccacggctcctacgaggtcaaggccaccgggagcgccagctccatgatcaacggcgtggtcaagctgctgaccaagccgtgggacgtggtgcccatggtcacgcagatggccatgaccgacaccacccccttcgggcagcagcgggtgttcaaggagaaggtggacacgcgcacgccccggagcatgccgggcacccgccgggtcatgggcatcaccgcggagtggctctggcgcacgctggggcggaacaagaagccccgcctgtgcacccgggaggagttcaccaagaaggtgcgcaccaacgccgccatgggcgccgtgttcacggaggagaaccagtgggactccgcgaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgccgggtgggacacccggatcaccgaggacgacctgcacaacgaggagaagatcacgcagcagatggaccccgagcaccgccagctcgcgaacgccatcttcaagctgacctaccagaacaaggtggtgaaggtccagcggccgacccccaccggcaccgtgatggacatcatcagccgcaaggaccagcggggctccggccaggtgggcacgtacagcctgaacaccttcaccaacatggaggcccagctcatccgccagatggagggggagggcgtcctgtccaaggccgacctggagaacccccacctccccgagaagaagatcacccagtggctggagacgaagggggtggagcggctgaagcgcatggccatcagcggcgacgactgcgtggtcaagccgatcgacgaccggttcgcgaacgccctcctggccctgaacgacatgggcaaggtgcgcaaggacatcccccagtggcagccctccaaggggtggcacgactggcagcaggtccccttctgcagccaccacttccacgagctcatcatgaaggacggccggaagctggtcgtgccgtgccgcccccaggacgagctgatcgggcgggcccgcatctcccagggcgccgggtggagcctccgggagaccgcgtgcctgggcaaggcctacgcccagatgtggtccctgatgtacttccaccgccgcgacctccggctggccagcaacgcgatctgcagcgccgtgcccgtccactgggtgcccacctcccgcaccacgtggagcatccacgcccaccaccagtggatgaccaccgaggacatgctgaccgtgtggaaccgggtctggatcgaggacaacccgtggatggaggacaagacgcccgtgaccacctgggagaacgtgccctacctcggcaagcgcgaggaccagtggtgcgggtccctgatcggcctgaccagccgggccacgtgggcccagaacatccccaccgcgatccagcaggtccgctccctcatcgggaacgaggagttcctggactacatgccgagcatgaagcggttccgcaaggaggaggagtccgagggcgccatctggtga

SEQ ID NO: 10198 - RNA, 9873 nt, synthetic construct
  misc_feature 1..9873: note = derived and/or modified CDS sequence (opt1) from DENV-3__FJ547082__SS-prME
  source 1..9873: mol_type = other RNA
accagcctctgcctcatgatgatcctgcccgccgccctggccttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgacgagcacctgggtgacctacgggacctgcaaccaggccggcgagcaccggcgcgacaagcggtccgtcgcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagatgtgggggaaggccaagatcgtcaccgccgagacccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgaccggatggggatgggcgtgacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatcttcaccctgaccgtcgcctggcgcaccgcgacgctgatcctcgccggggtgagcctgctgccggtctgccagtccagctccatgcggaagtccgactggctccccatgaccgtggccgccatgggcgtgccgcccctcccgctgttcatcttctccctcaaggacaccctgaagcgccgcagctggcccctgaacgagggggtcatggccgtgggcctcgtgtccatcctggcgagctccctgctccggaacgacgtccccatggccggccccctggtggccgggggcctgctcatcgcctgctacgtgatcaccgggacgagcgccgacctgaccgtcgagaaggcggccgacgtgacctgggaggaggaggccgagcagaccggcgtgtcccacaacctgatgatcacggtcgacgacgacgggaccatgcgcatcaaggacgacgagaccgagaacatcctcaccgtgctgctgaagaccgccctcctgatcgtgagcggcatcttcccgtactccatccccgccacgctgctcgtctggcacacctggcagaagcagacccggcgcagcggcgtgctgtgggacgtgcccagcccgcccgagacccagaaggcggagctggaggagggggtctaccggatcaagcagcagggcatcttcgggaagacccaggtgggcgtgggggtccagaaggagggcgtgttccacaccatgtggcacgtgacccgcggcgccgtcctcacctacaacgggaagcggctggagcccaactgggccagcgtgaagaaggacctgatctcctacggcgggggctggcgcctcagcgcccagtggcagaagggggaggaggtgcaggtcatcgcggtggagcccggcaagaaccccaagaacttccagacgatgcccggcaccttccagaccaccacgggggagatcggcgccatcgccctggacttcaagcccgggaccagcggctcccccatcatcaaccgggagggcaaggtggtcgggctgtacggcaacggggtggtgaccaagaacggcgggtacgtcagcggcatcgcccagaccaacgccgagccggacggccccacgcccgagctggaggaggagatgttcaagaagcgcaacctcaccatcatggacctgcaccccgggtccggcaagacccggaagtacctgccggcgatcgtgcgcgaggccatcaagcggcgcctccggaccctgatcctggcccccacgcgcgtggtcgccgccgagatggaggaggcgctcaaggggctgcccatccggtaccagaccaccgccaccaagagcgagcacacgggccgcgagatcgtggacctgatgtgccacgccaccttcaccatgcggctcctgtcccccgtgcgcgtcccgaactacaacctgatcatcatggacgaggcccacttcaccgaccccgccagcatcgcggcccgggggtacatctccacgcgcgtgggcatgggcgaggccgccgcgatcttcatgaccgccacgccgcccgggaccgccgacgccttcccgcagagcaacgcccccatccaggacgaggagcgcgacatccccgagcggtcctggaacagcggcaacgagtggatcacggacttcgcggggaagaccgtgtggttcgtcccctccatcaaggccggcaacgacatcgccaactgcctccgcaagaacgggaagaaggtgatccagctgagccggaagaccttcgacaccgagtaccagaagacgaagctgaacgactgggacttcgtggtcaccaccgacatctccgagatgggcgccaacttcaaggccgaccgcgtgatcgacccgcggcgctgcctcaagcccgtgatcctgaccgacggccccgagcgggtcatcctggcggggcccatgccggtgacggccgccagcgccgcccagcgccggggccgcgtggggcggaacccccagaaggagaacgaccagtacatcttcaccggccagcccctcaacaacgacgaggaccacgcgcactggaccgaggccaagatgctgctggacaacatcaacacccccgaggggatcatcccggccctcttcgagcccgagcgcgagaagtccgccgcgatcgacggcgagtaccggctgaagggcgagagccgcaagaccttcgtcgagctgatgcggcgcggggacctccccgtgtggctggcccacaaggtcgcctccgagggcatcaagtacacggaccggaagtggtgcttcgacgggcagcgcaacaaccagatcctggaggagaacatggacgtggagatctggaccaaggagggcgagaagaagaagctccggccccgctggctggacgcccgcacctacagcgacccgctggccctcaaggagttcaaggacttcgcggccggccggaagtccatcgccctggacctggtgaccgagatcgggcgcgtccccagccacctcgcccaccggacgcgcaacgccctggacaacctggtgatgctccacaccagcgagcacggcgggaaggcgtaccggcacgccgtggaggagctgcccgagaccatggagaccctgctcctgctgggcctcatgatcctgctgaccggcggggccatgctgttcctgatctccgggaaggggatcggcaagaccagcatcgggctgatctgcgtcatcgcctccagcggcatgctctggatggccgagatcccgctgcagtggatcgcgtccgccatcgtgctggagttcttcatgatggtgctcctgatccccgagcccgagaagcagcgcacgccccaggacaaccagctggcctacgtcgtgatcgggatcctcaccctggccgccatcatcgcggccaacgagatgggcctgctcgagacgaccaagcgggacctgggcatgagcaaggagccgggggtggtctcccccaccagctacctggacgtggacctccaccccgcctccgcctggaccctgtacgcggtggccacgaccgtcatcacccccatgctgcgccacaccatcgagaacagcacggccaacgtgtccctcgccgccatcgcgaaccaggccgtggtcctgatgggcctggacaaggggtggccgatcagcaagatggacctcggcgtgcccctgctggccctcgggtgctactcccaggtgaaccccctgaccctgaccgccgccgtcctcctgctgatcacccactacgcgatcatcggccccggcctccaggccaaggccacgcgggaggcccagaagcgcaccgccgcggggatcatgaagaacccgaccgtggacggcatcatgaccatcgacctggaccccgtgatctacgacagcaagttcgagaagcagctggggcaggtcatgctcctggtgctgtgcgccgtgcagctcctgctgatgcggacgtcctgggccctctgcgaggccctgaccctggcgaccggccccatcaccacgctctgggagggcagccccgggaagttctggaacaccaccatcgccgtctccatggccaacatcttccgcggcagctacctggccggggccggcctggcgttctccatcatgaagtccgtggggaccggcaagcggggcacggggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacccaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgacggaggtgcggggctacaccaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccacggtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacccacgagatgtactggatcagcaacggcacggggaacatcgtcgcgtccgtgaacatggtgagccggctcctgctgaaccgcttcaccatgacccaccggcgcccgaccatcgagaaggacgtcgacctcggcgccggcacgcggcacgtgaacgccgagcccgagacccccaacatggacgtgatcggggagcgcatcaagcggatcaaggaggagcacaactccacctggcactacgacgacgagaacccgtacaagacctgggcctaccacggcagctacgaggtcaaggccacggggtccgcgagcagcatgatcaacggcgtggtcaagctgctgaccaagccctgggacgtggtgcccatggtcacccagatggccatgaccgacacgacccccttcgggcagcagcgcgtgttcaaggagaaggtggacacccggaccccgcgctccatgcccggcacgcggcgcgtcatgggcatcaccgccgagtggctctggcggaccctggggcgcaacaagaagccccggctgtgcacccgcgaggagttcacgaagaaggtgcgcaccaacgccgcgatgggcgccgtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgcggacgacaccgccgggtgggacacgcgcatcaccgaggacgacctgcacaacgaggagaagatcacccagcagatggacccggagcaccggcagctcgccaacgccatcttcaagctgacctaccagaacaaggtggtgaaggtccagcgccccacgcccaccggcaccgtgatggacatcatctcccggaaggaccagcgcggcagcggccaggtgggcacctacgggctgaacaccttcacgaacatggaggcccagctcatccggcagatggagggcgagggggtcctgtccaaggcggacctggagaacccccacctcagcgagaagaagatcacccagtggctggagaccaagggcgtggagcgcctgaagcggatggccatctccggcgacgactgcgtggtcaagccgatcgacgaccgcttcgccaacgccctcctggccctgaacgacatggggaaggtgcggaaggacatcccccagtggcagcccagcaagggctggcacgactggcagcaggtccccttctgctcccaccacttccacgagctcatcatgaaggacgggcgcaagctggtcgtgccgtgccggccccaggacgagctgatcggccgcgcgcggatcagccagggggccggctggtccctccgcgagaccgcctgcctgggcaaggcctacgcgcagatgtggagcctgatgtacttccaccgccgggacctccgcctggcctccaacgccatctgcagcgccgtgcccgtccactgggtgcccacgagccggaccacctggtccatccacgcccaccaccagtggatgaccacggaggacatgctgaccgtgtggaaccgcgtctggatcgaggacaacccgtggatggaggacaagacccccgtgaccacgtgggagaacgtgccctacctcgggaagcgggaggaccagtggtgcggcagcctgatcgggctgacctcccgcgcgacctgggcccagaacatccccaccgccatccagcaggtccggagcctcatcggcaacgaggagttcctggactacatgccgtccatgaagcgcttccggaaggaggaggagagcgagggggccatctggtga

SEQ ID NO: 10199 - RNA, 9873 nt, synthetic construct
  misc_feature 1..9873: note = derived and/or modified CDS sequence (opt1) from DENV-3__FJ547083__SS-prME
  source 1..9873: mol_type = other RNA
accagcctctgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagtcctacgtctgcaagcacacctacgtggaccgcgggtggggcaacgggtgcggcctcttcgggaagggcagcctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggcctccaccaccgaggcgatcctgcccgagtacggcaccctggggctcgagtgcagcccgcggaccggcctggacttcaacgagatgatcctgctcacgatgaagaacaaggcctggatggtgcaccgccagtggttcttcgacctgcccctgccctggacctccggcgccaccaccgagacgcccacctggaaccggaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccgcctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgcgccgtgcaagatccccttcagcaccgaggacgggcagggcaaggcccacaacggccggctgatcacggccaaccccgtcgtgaccaagaaggaggagcccgtgaacatcgaggccgagccgcccttcggggagtccaacatcgtcatcggcatcggggacaacgcgctgaagatcaactggtacaagaagggcagctccatcgggaagatgttcgaggccaccgcccgcggcgcccggcgcatggccatcctgggcgacaccgcgtgggacttcgggagcgtgggcggggtgctcaactccctgggcaagatggtccaccagatcttcgggagcgcctacacggccctgttctccggcgtgagctgggtgatgaagatcggcatcggggtcctcctgacctggatcggcctgaactccaagaacaccagcatgtccttcagctgcatcgccatcgggatcatcaccctctacctgggcgccgtggtgcaggcggacatggggtgcgtcatcaactggaagggcaaggagctgaagtgcggctccgggatcttcgtgacgaacgaggtgcacacctggaccgagcagtacaagttccaggccgacagccccaagcgcctcgccaccgccatcgccggcgcgtgggagaacggggtctgcggcatccggtccacgacccgcatggagaacctgctgtggaagcagatcgccaacgagctcaactacatcctgtgggagaacaacatcaagctgaccgtggtggtcggggacaccatcggcgtgctcgagcagggcaagcggacgctgacgccccagccgatggagctgaagtacagctggaagacctgggggaaggccaagatcgtgaccgccgagacgcagaactccagcttcatcatcgacggccccaacacccccgagtgcccctccgcgagccgcgcctggaacgtctgggaggtggaggactacgggttcggcgtgttcaccaccaacatctggctcaagctgcgggaggtctacacccagctgtgcgaccaccgcctcatgagcgccgccgtgaaggacgagcgggccgtgcacgcggacatgggctactggatcgagtcccagaagaacgggagctggaagctggagaaggcctccctgatcgaggtcaagacgtgcacctggcccaagagccacaccctctggtccaacggcgtgctggagagcgacatgatcatccccaagtccctggccgggcccatcagccagcacaaccaccgcccgggctaccacacccagacggccgggccctggcacctcggcaagctggagctggacttcaactactgcgagggcaccaccgtggtcatcaccgagaactgcgggacgcggggcccctccctccgcaccaccaccgtgagcgggaagctgatccacgagtggtgctgccggtcctgcacgctgcccccgctccgctacatgggcgaggacgggtgctggtacggcatggagatccggcccatcagcgagaaggaggagaacatggtgaagtccctggtcagcgccggctccgggaaggtggacaacttcaccatgggcgtgctgtgcctcgcgatcctgttcgaggaggtcatgcgcgggaagttcggcaagaagcacatgatcgccggggtgttcttcaccttcgtgctgctcctgagcggccagatcacctggcgggacatggcccacacgctgatcatgatcggctccagcgccagcgaccgcatggggatgggcgtcacctacctcgccctgatcgcgaccttcaagatccagcccttcctggccctcgggttcttcctgcggaagctgacctcccgcgagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatgttcaccctgacggtggcctggcggaccgcgaccctgatcctcgccggggtcagcctgctgccggtgtgccagtccagctccatgcgcaagaccgactggctccccatggccgtcgccgccatgggcgtgccgcccctcccgctgttcatcttcagcctcaaggacacgctgaagcgccggtcctggcccctgaacgagggggtgatggcggtcggcctcgtgagcatcctggcctccagcctgctccgcaacgacgtgcccatggccggccccctggtcgccgggggcctgctcatcgcctgctacgtgatcaccgggacctccgcggacctgaccgtggagaaggccgccgacatcacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcgtgttcccgtacagcatccccgcgaccctgctcgtgtggcacacctggcagaagcagacgcagcgctccggcgtcctgtgggacgtgcccagcccgcccgagacccagaaggccgagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagcccaactgggcctccgtcaagaaggacctgatcagctacggcgggggctggcgcctcagcgcgcagtggcagaagggggaggaggtccaggtgatcgccgtcgagcccggcaagaaccccaagaacttccagaccatgcccggcaccttccagacgaccaccggggagatcggcgccatcgccctggacttcaagcccgggacctccggcagccccatcatcaaccgggagggcaaggtggtggggctgtacggcaacggggtcgtgacgaagaacggcgggtacgtgtccggcatcgcccagaccaacgcggagccggacggccccacccccgagctggaggaggagatgttcaagaagcgcaacctcaccatcatggacctgcaccccgggagcggcaagacgcggaagtacctgccggccatcgtccgcgaggccatcaagcggcgcctccggaccctgatcctggcccccacccgcgtggtggccgcggagatggaggaggccctcaaggggctgcccatccggtaccagaccacggccaccaagtccgagcacaccggccgcgagatcgtcgacctgatgtgccacgccaccttcacgatgcggctcctgagccccgtgcgcgtgccgaactacaacctgatcatcatggacgaggcccacttcaccgaccccgcgtccatcgccgcccgggggtacatcagcacccgcgtcggcatgggcgaggccgcggccatcttcatgaccgccacgccgcccgggaccgccgacgccttcccgcagtccaacgcgcccatccaggacgaggagcgcgacatccccgagcggagctggaactccggcaacgagtggatcaccgacttcgccgggaagaccgtgtggttcgtgcccagcatcaaggccggcaacgacatcgccaactgcctccgcaagaacgggaagaaggtcatccagctgtcccggaagacgttcgacaccgagtaccagaagaccaagctgaacgactgggacttcgtggtgaccacggacatcagcgagatgggcgccaacttcaaggcggaccgcgtcatcgacccgcggcgctgcctcaagcccgtgatcctgaccgacggccccgagcgggtgatcctggccgggcccatgccggtcaccgccgcctccgccgcgcagcgccggggccgcgtggggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccgcacgtactccgacccgctggcgctcaaggagttcaaggacttcgccgccggccgcaagagcatcgccctggacctggtgaccgagatcgggcgcgtgcccagccacctcgcccaccggacccgcaacgcgctggacaacctggtcatgctccacacctccgagcacggcgggcgggcctaccgccacgccgtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcggacgccccaggacaaccagctggcctacgtggtcatcgggatcctcaccctggccgcgatcatcgccgccaacgagatgggcctgctcgagaccaccaagcgcgacctgggcatgtccaaggagccgggggtggtgagccccacgtcctacctggacgtcgacctccaccccgccagcgcgtggaccctgtacgccgtggccaccaccgtgatcacgcccatgctgcggcacaccatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgacggccgcggtgctcctgctgatcacccactacgccatcatcggccccggcctccaggccaaggccacccgcgaggcccagaagcggaccgcggccgggatcatgaagaacccgacggtcgacggcatcatgaccatcgacctggaccccgtgatctacgactccaagttcgagaagcagctgggccaggtgatgctcctggtcctgtgcgccgtgcagctcctgctgatgcgcaccagctgggccctctgcgaggcgctgaccctggccacgggccccatcaccaccctctgggagggctcccccgggaagttctggaacaccacgatcgccgtgagcatggccaacatcttccggggctcctacctggccggggcgggcctggccttcagcatcatgaagtccgtcgggaccggcaagcgcggcaccgggtcccagggcgagaccctcggggagaagtggaagaagaagctgaaccagctgagccggaaggagttcgacctctacaagaagtccggcatcaccgaggtggaccgcacggaggccaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgcgggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccgcaccatccgggtcctgaagatggtggagccgtggctcaagaacaaccagttctgcatcaaggtgctgaacccctacatgcccacggtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcaccatgacgcaccgccggccgaccatcgagaaggacgtggacctcggcgccggcacccgccacgtcaacgccgagcccgagacccccaacatggacgtgatcggggagcggatcaagcgcatcaaggaggagcacaacagcacgtggcactacgacgacgagaacccgtacaagacctgggcctaccacggctcctacgaggtgaaggcgaccgggagcgccagctccatgatcaacggcgtcgtgaagctgctgaccaagccctgggacgtcgtgcccatggtgacgcagatggccatgaccgacaccacccccttcgggcagcagcgggtcttcaaggagaaggtggacacgcgcaccccgcggagcatgcccggcacccgccgggtgatgggcatcaccgccgagtggctctggcgcacgctggggcggaacaagaagccccgcctgtgcacccgcgaggagttcaccaagaaggtccggaccaacgcggccatgggcgccgtgttcacggaggagaaccagtgggactccgccaaggccgcggtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgcgatgtacgccgacgacaccgccgggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcgcagctcatccgccagatggagggcgagggggtgctgagcaaggccgacctggagaacccccacctcccggagaagaagatcacccagtggctggagacgaagggcgtcgagcggctgaagcgcatggccatctccggcgacgactgcgtggtgaagcccatcgacgaccggttcgccaacgccctcctggcgctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctccgcgagaccgcctgcctgggcaaggcgtacgcccagatgtggagcctgatgtacttccaccggcgcgacctccggctggcctccaacgccatctgcagcgccgtgcccgtgcactgggtcccgaccagccgcaccacgtggtccatccacgcgcaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10200 - RNA, 9873 nt, synthetic construct
  misc_feature 1..9873: note = derived and/or modified CDS sequence (opt1) from DENV-3__FJ547084__SS-prME
  source 1..9873: mol_type = other RNA
accagcctctgcctcatgatgatcctgcccgcggcgctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagcggggctccagcatcgggaagatgttcgaggcgaccgcccgcggcgcccggcgcatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccggagcacgacccgcatggagaacctgctgtggaagcagatcgcgaacgagctcaactacatcctgtgggagaacaacatcaagctgaccgtggtcgtgggggacaccatcggcgtgctcgagcagggcaagcggacgctgacgccccagccgatggagctgaagtactcctggaagacctgggggaaggccaagatcgtcaccgccgagacgcagaacagctccttcatcatcgacggccccaacacccccgagtgccccagcgcctcccgcgcgtggaacgtgtgggaggtggaggactacgggttcggcgtcttcaccaccaacatctggctcaagctgcgggaggtgtacacccagctgtgcgaccaccgcctcatgagcgccgccgtgaaggacgagcgggccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccgcccgggctaccacacccagacggccgggccctggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgcccccgctccgctacatgggcgaggacgggtgctggtacggcatggagatccggcccatctccgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgtgggggtcttcttcaccttcgtgctgctcctgtccggccagatcacctggcgggacatggcgcacacgctgatcatgatcggcagcaacgcctccgaccgcatggggatgggcgtgacctacctcgccctgatcgccaccttcaagatccagcccttcctggccctcgggttcttcctgcggaagctgaccagccgcgagaacctcctgctgggcgtcggcctcgcgatggccacgaccctgcagctgcccgaggacatcgagcagatggccaacgggatcgccctcggcctgatggcgctgaagctcaccacccagttcgagacgtaccagctgtggaccgccctgatcagcctgacctgctccaacaccatcttcacgctgaccgtggcctggcggaccgccaccctgatcctcgccggggtcagcctgctgccggtgtgccagtccagctccatgcgcaagacggactggctccccatgaccgtggcggccatgggcgtgccgcccctcccgctgttcatcttcagcctcaaggacaccctgaagcgccggtcctggcccctgaacgagggggtgatggccgtgggcctcgtcagcatcctggcctccagcctgctccgcaacgacgtgcccatggccggccccctggtggccggcgggctgctcatcgcctgctacgtcatcaccgggacgtccgccgacctgaccgtggagaaggccgccgacgtgacctgggaggaggaggcggagcagaccggggtcagccacaacctgatgatcaccgtggacgacgacgggacgatgcggatcaaggacgacgagaccgagaacatcctcaccgtgctgctgaagaccgccctcctgatcgtctccggcatcttcccgtacagcatccccgccacgctgctcgtgtggcacacctggcagaagcagacccagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacctacaacgggaagcggctggagcccaactgggcgtccgtgaagaaggacctgatcagctacggcgggggctggcgcctctccgcccagtggcagaagggggaggaggtccaggtgatcgccgtggagcccggcaagaaccccaagaacttccagacgatgcccggcaccttccagaccaccacgggggagatcggcgccatcgcgctggacttcaagcccgggaccagcggcagccccatcatcaaccgggagggcaaggtcgtggggctgtacggcaacggggtggtcaccaagaacggcgggtacgtgtccggcatcgcccagaccaacgccgagccggacggccccacgcccgagctggaggaggagatgttcaagaagcgcaacctcaccatcatggacctgcaccccgggagcggcaagacccggaagtacctgccggccatcgtgcgcgaggccatcaagcggcgcctccggaccctgatcctggcgcccacgcgcgtcgtggccgccgagatggaggaggccctcaaggggctgcccatccggtaccagaccaccgccaccaagtccgagcacacgggccgcgagatcgtggacctgatgtgccacgcgaccttcaccatgcggctcctgagccccgtccgcgtgccgaactacaacctgatcatcatggacgaggcccacttcaccgaccccgcctccatcgccgcccgggggtacatcagcacgcgcgtgggcatgggcgaggcggccgccatcttcatgaccgccacgccgcccgggaccgcggacgccttcccgcagtccaacgcccccatccaggacgaggagcgcgacatccccgagcggagctggaactccggcaacgagtggatcacggacttcgccgggaagaccgtctggttcgtgcccagcatcaaggccggcaacgacatcgcgaactgcctccgcaagaacgggaagaaggtgatccagctgtcccggaagaccttcgacaccgagtaccagaagacgaagctgaacgactgggacttcgtcgtgaccaccgacatcagcgagatgggcgccaacttcaaggccgaccgcgtgatcgacccgcggcgctgcctcaagcccgtcatcctgaccgacggccccgagcgggtgatcctggccgggcccatgccggtgaccgccgcgtccgccgcccagcgccggggccgcgtcgggcggaacccccagaaggagaacgaccagtacatcttcacgggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcccacaaggtggcgagcgagggcatcaagtacacggaccggaagtggtgcttcgacgggcagcgcaacaaccagatcctggaggagaacatggacgtggagatctggaccaaggagggcgagaagaagaagctccggccccgctggctggacgcccgcacctactccgacccgctggccctcaaggagttcaaggacttcgccgccggccgcaagagcatcgcgctggacctggtcaccgagatcgggcgcgtgccctcccacctcgcccaccggacgcgcaacgccctggacaacctggtgatgctccacaccagcgagcacggcgggaaggcctaccggcacgccgtcgaggagctgcccgagaccatggagaccctgctcctgctgggcctcatgatcctgctgaccggcggggcgatgctgttcctgatcagcgggaaggggatcggcaagacctccatcgggctgatctgcgtgatcgccagctccggcatgctctggatggccgagatcccgctgcagtggatcgccagcgccatcgtgctggagttcttcatgatggtcctcctgatccccgagcccgagaagcagcgcacgccccaggacaaccagctggcgtacgtggtgatcgggatcctcaccctggccgccatcatcgccgccaacgagatgggcctgctcgagacgaccaagcgggacctgggcatgtccaaggagccgggggtcgtgagccccacctcctacctggacgtggacctccaccccgcgagcgcctggaccctgtacgccgtcgccacgaccgtgatcacccccatgctgcgccacaccatcgagaactccacggcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgaccctgaccgccgccgtgctcctgctgatcacccactacgccatcatcggccccggcctccaggccaaggcgacgcgggaggcccagaagcgcaccgccgccgggatcatgaagaacccgaccgtggacggcatcatgaccatcgacctggaccccgtcatctacgactccaagttcgagaagcagctgggccaggtgatgctcctggtgctgtgcgccgtccagctcctgctgatgcggacgagctgggcgctctgcgaggccctgaccctggccaccggccccatcaccacgctctgggagggctcccccgggaagttctggaacaccaccatcgccgtgagcatggcgaacatcttccgcggctcctacctggccggggccggcctggccttcagcatcatgaagtccgtggggaccggcaagcggggcaccgggagccagggcgagacgctcggggagaagtggaagaagaagctgaaccagctgagccgcaaggagttcgacctctacaagaagtccggcatcaccgaggtcgaccggaccgaggccaaggaggggctgaagcgcggcgagatcacccaccacgcggtgagccggggctccgccaagctgcagtggttcgtggagcgcaacatggtcatcccggaggggcgggtgatcgacctcggctgcgggcgcggcgggtggagctactactgcgccggcctgaagaaggtgacggaggtccggggctacaccaagggcggccccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccacggtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcacggggaacatcgtggccagcgtgaacatggtctcccggctcctgctgaaccgcttcaccatgacccaccggcgcccgaccatcgagaaggacgtggacctcggcgccggcacgcggcacgtgaacgcggagcccgagacccccaacatggacgtcatcggggagcgcatcaagcggatcaaggaggagcacaacagcacctggcactacgacgacgagaacccgtacaagacctgggcctaccacggctcctacgaggtgaaggccacggggagcgcctccagcatgatcaacggcgtcgtgaagctgctgaccaagccctgggacgtggtccccatggtgacccagatggccatgaccgacacgacccccttcgggcagcagcgcgtgttcaaggagaaggtcgacacccggaccccgcgcagcatgcccggcacgcggcgcgtgatgggcatcaccgcggagtggctctggcggaccctggggcgcaacaagaagccccggctgtgcacccgcgaggagttcacgaagaaggtgcgcaccaacgccgccatgggcgccgtcttcaccgaggagaaccagtgggactccgcgaaggccgccgtggaggacgaggacttctggaagctcgtggaccgggagcgcgagctgcacaagctggggaagtgcggcagctgcgtctacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgccgggtgggacacgcgcatcaccgaggacgacctgcacaacgaggagaagatcacccagcagatggacccggagcaccggcagctcgcgaacgccatcttcaagctgacctaccagaacaaggtggtcaaggtgcagcgccccacccccacgggcaccgtgatggacatcatcagccggaaggaccagcgcggctccgggcaggtcggcacctacgggctgaacaccttcacgaacatggaggcccagctcatccggcagatggagggcgagggggtgctgagcaaggccgacctggagaacccccacctcccggagaagaagatcacccagtggctggagaccaagggcgtggagcgcctgaagcggatggccatctccggcgacgactgcgtcgtgaagcccatcgacgaccgcttcgcgaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctccgcgagaccgcgtgcctgggcaaggcctacgcccagatgtggagcctgatgtacttccaccgccgggacctccgcctggcctccaacgcgatctgcagcgccgtccccgtgcactgggtgccgacgtcccggaccacctggagcatccacgcccaccaccagtggatgaccacggaggacatgctgaccgtctggaaccgcgtgtggatcgaggacaacccctggatggaggacaagacccccgtgaccacgtgggagaacgtcccctacctcgggaagcgggaggaccagtggtgcggcagcctgatcgggctgacctcccgcgccacctgggcccagaacatcccgaccgcgatccagcaggtccggagcctcatcggcaacgaggagttcctggactacatgccctccatgaagcgcttccggaaggaggaggagagcgagggggccatctggtga

SEQ ID NO: 10201 - RNA, 9873 nt, synthetic construct
  misc_feature 1..9873: note = derived and/or modified CDS sequence (opt1) from DENV-3__FJ478456__SS-prME
  source 1..9873: mol_type = other RNA
accagcctgtgcctcatgatgatcctgcccgccgccctggccttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacctgcaaccaggccggcgagcaccggcgcgacaagcggtccgtcgcgctcgcgccccacgtgggcatggggctggacacgcgcacccagacctggatgagcgccgagggcgcctggcgccaggtggagaaggtcgagacctgggcgctgcgccacccggggttcacgatcctcgccctgttcctggcccactacatcggcacctccctcacccagaaggtggtgatcttcatcctgctgatgctcgtcacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacaccgggtgcgtgatcaactggaagggcaaggagctgaagtgcggcagcgggatcttcgtgacgaacgaggtccacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgcgatcctgttcgaggaggtgatgcgggggaagttcggcaagaagcacatgatcgccggggtgttcttcaccttcgtcctgctcctgtccggccagatcacctggcgcgacatggcccacaccctgatcatgatcggcagcaacgcctccgaccggatggggatgggcgtgacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtcgcctggcgcacggcgaccctgatcctcgccggggtgagcatcctgccggtctgccagtccagctccatgcggaagtccgactggctgcccatgaccgtggccgccatgggcgtgccgcccctcccgctgttcatcttctccctgaaggacaccctcaagcgccgcagctggcccctgaacgagggggtcatggccgtgggcctggtgtccatcctcgcgagctccctgctgcggaacgacgtccccatggccggccccctcgtggccgggggcctgctgatcgcctgctacgtgatcacggggaccagcgccgacctcaccgtcgagaaggcggccgacgtgacctgggaggaggaggccgagcagacgggcgtgtcccacaacctgatgatcaccgtcgacgacgacgggaccatgcgcatcaaggacgacgagaccgagaacatcctgaccgtgctcctgaagacggccctgctcatcgtgagcggcatcttcccgtactccatccccgccaccctgctggtctggcacacctggcagaagcagacccggcgcagcggcgtgctctgggacgtgcccagcccgcccgagacgcagaaggcggagctggaggagggggtctaccggatcaagcagcagggcatcttcgggaagacccaggtgggcgtgggggtccagaaggagggcgtgttccacaccatgtggcacgtgacccgcggcgccgtcctgacgtacaacgggaagcggctcgagcccaactgggccagcgtgaagaaggacctgatctcctacggcgggggctggcgcctgagcgcccagtggcagaagggggaggaggtgcaggtcatcgcggtggagcccggcaagaaccccaagaacttccagaccatgcccggcaccttccagaccacgaccggggagatcggcgccatcgccctcgacttcaagcccgggaccagcggctcccccatcatcaaccgggagggcaaggtggtcgggctgtacggcaacggggtggtgaccaagaacggcgggtacgtcagcggcatcgcccagacgaacgccgagccggacggccccacccccgagctggaggaggagatgttcaagaagcgcaacctgaccatcatggacctccaccccgggtccggcaagacccggaagtacctgccggcgatcgtgcgcgaggccatcaagcggcgcctgcggacgctcatcctggcccccacccgcgtggtcgccgccgagatggaggaggcgctgaaggggctccccatccggtaccagaccaccgccaccaagagcgagcacaccggccgcgagatcgtggacctgatgtgccacgccaccttcaccatgcggctgctctcccccgtgcgcgtcccgaactacaacctgatcatcatggacgaggcccacttcacggaccccgccagcatcgcggcccgggggtacatctccacccgcgtgggcatgggcgaggccgccgcgatcttcatgaccgccacgccgcccgggacggccgacgccttcccgcagagcaacgcccccatccaggacgaggagcgcgacatccccgagcggtcctggaacagcggcaacgagtggatcaccgacttcgcggggaagaccgtgtggttcgtcccctccatcaaggccggcaacgacatcgccaactgcctgcgcaagaacgggaagaaggtgatccagctcagccggaagaccttcgacacggagtaccagaagaccaagctgaacgactgggacttcgtggtcaccaccgacatctccgagatgggcgccaacttcaaggccgaccgcgtgatcgacccgcggcgctgcctgaagcccgtgatcctcacggacggccccgagcgggtcatcctggcggggcccatgccggtgaccgccgccagcgccgcccagcgccggggccgcgtggggcggaacccccagaaggagaacgaccagtacatcttcaccggccagcccctgaacaacgacgaggaccacgcgcactggaccgaggccaagatgctcctggacaacatcaacacccccgaggggatcatcccggccctgttcgagcccgagcgcgagaagtccgccgcgatcgacggcgagtaccggctcaagggcgagagccgcaagacgttcgtcgagctgatgcggcgcggggacctgcccgtgtggctcgcccacaaggtcgcctccgagggcatcaagtacaccgaccggaagtggtgcttcgacgggcagcgcaacaaccagatcctggaggagaacatggacgtggagatctggaccaaggagggcgagaagaagaagctgcggccccgctggctcgacgcccgcacctacagcgacccgctggccctgaaggagttcaaggacttcgcggccggccggaagtccatcgccctcgacctggtgacggagatcgggcgcgtccccagccacctggcccaccggacccgcaacgccctcgacaacctggtgatgctgcacaccagcgagcacggcgggaaggcgtaccggcacgccgtggaggagctccccgagaccatggagacgctgctgctcctgggcctgatgatcctcctgaccgggggcgccatgctgttcctcatctccggcaaggggatcggcaagaccagcatcgggctgatctgcgtcatcgcctccagcggcatgctgtggatggccgagatcccgctccagtggatcgcgtccgccatcgtgctggagttcttcatgatggtgctgctcatccccgagcccgagaagcagcgcacgccccaggacaaccagctggcctacgtcgtgatcgggatcctgacgctcgccgccatcatcgcggccaacgagatgggcctgctggagaccaccaagcgggacctcggcatgagcaaggagccgggggtggtctcccccaccagctacctggacgtggacctgcaccccgcctccgcctggacgctctacgcggtggccaccaccgtcatcacccccatgctgcgccacacgatcgagaacagcaccgccaacgtgtccctggccgccatcgcgaaccaggccgtggtcctcatgggcctggacaaggggtggccgatcagcaagatggacctgggcgtgcccctcctggccctggggtgctactcccaggtgaaccccctcaccctgaccgccgccgtcctgctcctgatcacgcactacgcgatcatcggccccggcctgcaggccaaggccacccgggaggcccagaagcgcaccgccgcggggatcatgaagaacccgaccgtggacggcatcatgacgatcgacctcgaccccgtgatctacgacagcaagttcgagaagcagctggggcaggtcatgctgctcgtgctgtgcgccgtgcagctgctcctgatgcggacctcctgggccctgtgcgaggccctcaccctggcgaccggccccatcacgaccctgtgggagggcagccccgggaagttctggaacaccaccatcgccgtctccatggccaacatcttccgcggcagctacctcgccggggccggcctggcgttctccatcatgaagtccgtggggacgggcaagcggggcaccgggagccagggcgagaccctgggggagaagtggaagaagaagctcaaccagctgtcccgcaaggagttcgacctgtacaagaagtccggcatcaccgaggtggaccggaccgaggccaaggaggggctcaagcgcggcgagatcacgcaccacgccgtctcccggggcagcgccaagctgcagtggttcgtggagcgcaacatggtgatcccggaggggcgggtcatcgacctgggctgcgggcgcggcgggtggtcctactactgcgccggcctcaagaaggtgaccgaggtgcggggctacaccaagggcgggcccgggcacgaggagcccgtccccatgagcacctacggctggaacatcgtgaagctgatgtccgggaaggacgtgttctacctgccgcccgagaagtgcgacacgctcctgtgcgacatcggcgagagctcccccagccccaccgtcgaggagtcccgcaccatccgcgtgctgaagatggtggagccgtggctgaagaacaaccagttctgcatcaaggtcctcaacccctacatgcccaccgtgatcgagcacctggagcggctgcagcgcaagcacggcgggatgctcgtgcggaaccccctgagccgcaactccacgcacgagatgtactggatcagcaacggcaccgggaacatcgtcgcgtccgtgaacatggtgagccggctgctcctgaaccgcttcaccatgacccaccggcgcccgacgatcgagaaggacgtcgacctgggcgccggcacccggcacgtgaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggccaccgggtccgcgagcagcatgatcaacggcgtggtcaagctcctgaccaagccctgggacgtggtgcccatggtcacccagatggccatgacggacaccacccccttcgggcagcagcgcgtgttcaaggagaaggtggacacccggacgccgcgctccatgcccggcacccggcgcgtcatgggcatcaccgccgagtggctgtggcggaccctcgggcgcaacaagaagccccggctgtgcacgcgcgaggagttcaccaagaaggtgcgcaccaacgccgcgatgggcgccgtgttcaccgaggagaaccagtgggacagcgccaaggccgccgtcgaggacgaggacttctggaagctggtggaccgggagcgcgagctccacaagctggggaagtgcggctcctgcgtgtacaacatgatggggaagcgggagaagaagctgggcgagttcggcaaggcgaaggggagccgcgccatctggtacatgtggctcggcgcccggtacctggagttcgaggccctggggttcctcaacgaggaccactggttctcccgcgagaacagctactccggcgtcgagggggagggcctgcacaagctgggctacatcctccgggacatcagcaagatccccgggggcgccatgtacgcggacgacacggccgggtgggacacccgcatcaccgaggacgacctgcacaacgaggagaagatcacccagcagatggacccggagcaccggcagctggccaacgccatcttcaagctcacgtaccagaacaaggtggtgaaggtccagcgccccacccccaccggcaccgtgatggacatcatctcccggaaggaccagcgcggcagcggccaggtgggcacctacgggctgaacacgttcaccaacatggaggcccagctgatccggcagatggagggcgagggggtcctctccaaggcggacctggagaacccccacctgagcgagaagaagatcacccagtggctcgagaccaagggcgtggagcgcctgaagcggatggccatctccggcgacgactgcgtggtcaagccgatcgacgaccgcttcgccaacgccctgctcgccctgaacgacatggggaaggtgcggaaggacatcccccagtggcagcccagcaagggctggcacgactggcagcaggtccccttctgctcccaccacttccacgagctgatcatgaaggacgggcgcaagctcgtcgtgccgtgccggccccaggacgagctgatcggccgcgcgcggatcagccagggggccggctggtccctgcgcgagacggcctgcctcggcaaggcctacgcgcagatgtggagcctgatgtacttccaccgccgggacctgcgcctcgcctccaacgccatctgcagcgccgtgcccgtccactgggtgcccaccagccggaccacctggtccatccacgcccaccaccagtggatgacgaccgaggacatgctgaccgtgtggaaccgcgtctggatcgaggacaacccgtggatggaggacaagacccccgtgacgacctgggagaacgtgccctacctggggaagcgggaggaccagtggtgcggcagcctcatcgggctgacctcccgcgcgacctgggcccagaacatccccacggccatccagcaggtccggagcctgatcggcaacgaggagttcctcgactacatgccgtccatgaagcgcttccggaaggaggaggagagcgagggggccatctggtga

SEQ ID NO: 10202 - RNA, 9873 nt, synthetic construct
  misc_feature 1..9873: note = derived and/or modified CDS sequence (opt1) from DENV-3__FJ547085__SS-prME
  source 1..9873: mol_type = other RNA
accagcctctgcctcatgatgatcctgcccgcggcgctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcccggatcgtcaccgccgagacgcagaacagctccttcatcatcgacggccccaacacccccgagtgccccaacaccagccgcgcctggaacgtgtgggaggtggaggactacgggttcggcgtcttcaccaccaacatctggctcaagctgcgggaggtgtacacgcagctgtgcgaccaccgcctcatgtccgcggccgtgaaggacgagcgggccgtccacgccgacatgggctactggatcgagagccagaagaacgggagctggaagctggagaaggcctccctgatcgaggtgaagacctgcacctggcccaagagccacaccctctggtccaacggcgtgctggagagcgacatgatcatccccaagtccctggcggggcccatcagccagcacaactaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcagcgagaaggaggagaacatggtcaagtccctggtgagcgccggctccggggaggtggacaacttcaccatgggcgtcctgtgcctcgccatcctgttcgaggaggtgatgcgcgggaagttcggcaagaagcacatgatcgccggggtgttcttcaccttcgtcctgctcctgagcggccagatcacgtggcgggacatggcgcacaccctgatcatgatcggctccaacgccaccgaccgcatggggatgggcgtgacctacctcgccctgatcgccacgttcaagatccagcccttcctggccctcgggttcttcctgcggaagctgaccagccgcgagaacctcctgctgggcgtgggcctcgcgatggccaccaccctgcagctgcccgaggacatcgagcagatggccaacgggatcgccctcggcctgatggcgctgaagctcatcacgcagttcgagacctaccagctgtggaccgccctgatctccctgacctgcagcaacacgatcttcaccctgaccgtcgcctggcggaccgccacgctgatcctcgccggggtgagcctgctgccggtctgccagtccagctccatgcgcaagaccgactggctccccatgaccgtggcggccatgggcgtgccgcccctcccgctgttcatcttcagcctcaaggacaccctgaagcgccggtcctggcccctgaacgagggggtcatggccgtgggcctcgtgagcatcctggcctccagcctgctccgcaacgacgtccccatggccggccccctggtggccggcgggctgctcatcgcctgctacgtgatcacggggacctccgccgacctgaccgtcgagaaggccgccgacgtgacctgggaggaggaggcggagcagaccggggtgagccacaacctgatgatcacggtcgacgacgacgggaccatgcggatcaaggacgacgagaccgagaacatcctcaccgtgctgctgaagacggccctcctgatcgtgtccggcatcttcccgtacagcatccccgccaccctgctcgtctggcacacctggcagaagcagacccagcgctccggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcgtccgtgaagaaggacctgatcagctacggcgggggctggcgcctctccgcccagtggcagaagggggaggaggtgcaggtcatcgccgtggagcccggcaagaaccccaagaacttccagaccatgcccggcaccttccagaccacgaccggggagatcggcgccatcgcgctggacttcaagcccgggaccagcggctcccccatcatcaaccgggagggcaaggtggtcgggctgtacggcaacggggtggtgaccaagaacggcgggtacgtcagcggcatcgcccagacgaacgccgagccggacggccccacccccgagctggaggaggagatgttcaagaagcgcaacctcaccatcatggacctgcaccccgggagcggcaagacccggaagtacctgccggccatcgtgcgcgaggccatcaagcggcgcctccggacgctgatcctggcgcccacccgcgtggtcgccgccgagatggaggaggccctcaaggggctgcccatccggtaccagaccaccgccacgaagtccgagcacaccggccgcgagatcgtggacctgatgtgccacgcgaccttcaccatgcggctcctgagccccgtgcgcgtcccgaactacaacctgatcatcatggacgaggcccacttcacggaccccgcctccatcgccgcccgggggtacatcagcacccgcgtgggcatgggcgaggcggccgccatcttcatgaccgccacgccgcccgggacggcggacgccttcccgcagtccaacgcccccatccaggacgaggagcgcgacatccccgagcggagctggaactccggcaacgagtggatcaccgacttcgccgggaagaccgtgtggttcgtccccagcatcaaggccggcaacgacatcgcgaactgcctccgcaagaacgggaagaaggtgatccagctgtcccggaagaccttcgacacggagtaccagaagaccaagctgaacgactgggacttcgtggtcaccaccgacatcagcgagatgggcgccaacttcaaggccgaccgcgtgatcgacccgcggcgctgcctcaagcccgtgatcctgaccgacggccccgagcgggtcatcctggccgggcccatgccggtgacggccgcgtccgccgcccagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagtcccgcaagacgttcgtcgagctgatgcggcgcggggacctccccgtgtggctggcccacaaggtcgcgagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctactccgacccgctggccctcaaggagttcaaggacttcgccgccggccgcaagagcatcgcgctggacctggtgacggagatcgggcgcgtccccacccacctcgcccaccggacccgcaacgccctggacaacctggtgatgctccacacctccgagcacggcgggaaggcctaccggcacgccgtggaggagctgcccgagacgatggagaccctgctcctgctgggcctcatgatcctgctgaccgggggcgcgatgctgttcctgatcagcggcaaggggatcggcaagacctccatcgggctgatctgcgtcatcgccagcagcggcatgctctggatggccgagatcccgctgcagtggatcgcctccgccatcgtgctggagttcttcatgatggtgctcctgatccccgagcccgagaagcagcgcacgccccaggacaaccagctggcgtacgtcgtgatcgggatcctcaccctggccgccatcatcgccgccaacgagatgggcctgctcgagaccaccaagcgggacctgggcatgagcaaggagccgggggtggtctcccccacgagctacctggacgtggacctccaccccgcgtccgcctggaccctgtacgccgtggccaccaccgtcatcacgcccatgctgcgccacaccatcgagaacagcaccgcgaacgtgtccctcgccgccatcgccaaccaggccgtggtcctgatgggcctggacaaggggtggccgatcagcaagatggacctcggcgtgcccctgctggcgctcgggtgctactcccaggtgaaccccctgaccctgacggccgccgtcctcctgctgatcacccactacgccatcatcggccccggcctccaggccaaggcgacccgggaggcccagaagcgcaccgccgccgggatcatgaagaacccgacggtggacggcatcatgaccatcgacctggaccccgtgatctacgacagcaagttcgagaagcagctggggcaggtcatgctcctggtgctgtgcgccgtgcagctcctgctgatgcggacctcctgggcgctctgcgaggccctgaccctggccacgggccccatcaccaccctctgggagggcagccccgggaagttctggaacaccaccatcgccgtctccatggcgaacatcttccgcggcagctacctggccggggccggcctggccttctccatcatgaagtccgtggggacgggcaagcggggcaccgggtcccagggcgagaccctcggggagaagtggaagaagaagctgaaccagctgagccgcaaggagttcgacctctacaagaagtccggcatcaccgaggtggaccggacggaggccaaggaggggctgaagcgcggcgagatcacccaccacgcggtcagccggggcaccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacacgaagggcggccccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccgcacgatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgctccatgcccggcacccggcgcgtcatggagatcaccgccgagtggctctggcggacgctgggccgcaacaagaagccccggctgtgcacccgcgaggagttcaccaagaaggtgcgcaccaacgccgccatgggggcggtgttcacggaggagaaccagtgggacagcgccaaggccgccgtcgaggacgaggacttctggaagctcgtggaccgggagcgcgagctgcacaagctgggcaagtgcgggtcctgcgtgtacaacatgatgggcaagcgggagaagaagctcggggagttcggcaaggccaagggcagccgcgcgatctggtacatgtggctgggggcccggtacctggagttcgaggccctcggcttcctgaacgaggaccactggttcagccgcgagaactcctacagcggggtcgagggcgaggggctgcacaagctcggctacatcctgcgggacatctccaagatccccggcggggccatgtacgccgacgacaccgcgggctgggacacccgcatcaccgaggacgacctgcacaacgaggagaagatcacccagcagatggacccggagcaccggcagctcgccaacgccatcttcaagctgacgtaccagaacaaggtggtgaaggtccagcgccccacccccaccgggaccgtgatggacatcatcagccggaaggaccagcgcggctccggccaggtggggacgtacggcctgaacaccttcaccaacatggaggcccagctcatccggcagatggagggggagggcgtcctgagcaaggccgacctggagaacccccacctcccggagaagaagatcacccagtggctggagacgaagggggtggagcgcctgaagcggatggcgatctccggcgacgactgcgtggtcaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccggatcagccagggcgcggggtggtccctccgcgagaccgcctgcctgggcaaggcctacgcccagatgtggagcctgatgtacttccaccgccgggacctccgcctggcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccgtgaccacctgggagaacgtgccctacctcggcaagcgggaggaccagtggtgcgggtccctgatcggcctgaccagccgcgccacgtgggcgcagaacatcccgaccgccatccagcaggtccggtccctcatcgggaacgaggagttcctggactacatgcccagcatgaagcgcttccggaaggaggaggagagcgagggcgccatctggtga

SEQ ID NO: 10203 - RNA, 9873 nt, synthetic construct
  misc_feature 1..9873: note = derived and/or modified CDS sequence (opt1) from DENV-3__EU482595__SS-prME
  source 1..9873: mol_type = other RNA
accagcctctgcctcatgatgatgctgcccgcggccctggcgttccacctcaccagccgggacggcgagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacgtgggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaaggtgcccttcagcaccgaggacgggcagggcaaggcgcacaacggccgcctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgtgatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggccgactcccccaagcgcctcgcgaccgccatcgccggcgcctgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcatcctgacgccccagccgatggagctgaagtactcctggaagacgtgggggaaggcgaagatcgtcaccgccgagacccagaacagctccttcatcatcgacggccccaacacccccgagtgccccagcgcctcccgggcctggaacgtgtgggaggtggaggactacgggttcggcgtcttcagcacgaacatctggctcaagctgcgcgaggtgtacacccagctgtgcgaccaccggctcatgagcgcggccgtgaaggacgagcgcgccgtccacgccgacatgggctactggatcgagtcccagaagaacgggagctggaagctggagaaggcctccctgatcgaggtgaagacctgcacctggcccaagtcccacaccctctggtccaacggcgtgctggagagcgacatgatcatccccaagtccctggcggggcccatcagccagcacaactaccggccgggctaccacacgcagaccgccgggccctggcacctcggcaagctggagctggacttcaactactgcgagggcaccaccgtcgtgatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgttcttcaccttcgtcctgctcctgagcggccagatcacgtggcgcgacatggcgcacaccctgatcatgatcggctccaacgccagcgaccggatggggatgggcgtgacctacctcgccctgatcgccaccttcaagatccagcccttcctggccctcgggttcttcctgcgcaagctgacgagccgggagaacctcctgctgggcgtcggcctcgcgatggccaccaccctgcagctgcccgaggacatcgagcagatggccaacgggatcgccctcggcctgatggcgctgaagctcatcacccagttcgagacgtaccagctgtggaccgccctgatctccctgacctgcagcaacaccatcttcacgctgaccgtggcctggcgcaccgccaccctgatcctcgccggggtgtccctgctgccggtctgccagagctccagcatgcggaagacggactggctccccatgaccgtggcggccatgggcgtgccgcccctcccgctgttcatcttctccctcaaggacaccctgaagcgccgcagctggcccctgaacgagggggtcatggccgtgggcctcgtgtccatcctggccagctccctgctccggaacgacgtccccatggccggccccctggtggccggcgggctgctcatcgcctgctacgtgatcaccgggacgagcgccgacctgaccgtcgagaaggccgccgacgtgacctgggaggaggaggcggagcagaccggggtgtcccacaacctgatgatcacggtcgacgacgacgggaccatgcgcatcaaggacgacgagaccgagaacatcctcaccgtgctgctgaagaccgccctcctgatcgtgagcggcatcttcccgtactccatccccgccacgctgctcgtctggcacacctggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggcgagcgtgaagaaggacctgatctcctacggcgggggctggcggctcagcgcccagtggcagaagggggaggaggtgcaggtcatcgccgtggagcccggcaagaaccccaagaacttccagacgatgcccggcaccttccagaccaccacgggggagatcggcgccatcgcgctggacttcaagcccgggaccagcggctcccccatcatcaaccgcgagggcaaggtggtcgggctgtacggcaacggggtggtgaccaagaacggcgggtacgtcagcggcatcgcccagaccaacgccgagccggacggccccgcccccgagctggaggaggagatgttcaagaagcggaacctcacgatcatggacctgcaccccgggtccggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagagcgagcacaccggccgggagatcgtggacctgatgtgccacgccacgttcaccatgcgcctcctgtcccccgtgcgggtcccgaactacaacctgatcatcatggacgaggcccacttcaccgaccccgccagcatcgccgcgcgcgggtacatctccacccgggtgggcatgggcgaggccgccgccatcttcatgacggcgacgccgcccgggaccgccgacgccttcccgcagagcaacgcccccatccaggacgaggagcgcgacatccccgagcgctcctggaacagcggcaacgagtggatcaccgacttcgccgggaagacggtgtggttcgtcccctccatcaaggcgggcaacgacatcgccaactgcctccggaagaacgggaagaaggtgatccagctgagccgcaagaccttcgacaccgagtaccagaagaccaagctgaacgactgggacttcgtggtcacgaccgacatctccgagatgggcgccaacttcaaggccgaccgggtgatcgacccgcgccggtgcctcaagcccgtgatcctgaccgacggccccgagcgcgtcatcctggccgggcccatgccggtgaccgcggccagcgccgcccagcggcgcggccgggtcgggcgcaacccccagaaggagaacgaccagtacatcttcacgggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagaccttcgtggagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctacagcgacccgctggccctcaaggagttcaaggacttcgccgcgggccgcaagtccatcgccctggacctggtgaccgagatcgggcgggtccccagccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatctccggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggagccagggcgagacgctcggggagaagtggaagaagaagctgaaccagctgtcccggaaggagttcgacctctacaagaagtccggcatcaccgaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtcatcggggagcggatcaagcgcatcaaggaggagcacaactccacctggcactacgacgacgagaacccgtacaagacctgggcctaccacggcagctacgaggtgaaggccaccgggtccgccagcagcatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggtccatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggatcctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccacgggcaccgtgatggacatcatctcccgcaaggaccagcggggcagcggccaggtgggcacctacgggctgaacaccttcaccaacatggaggcccagctcatccgccagatggagggcgagggggtcctgtccaaggccgacctggagaacccccacctcccggagaagaagatcacgcagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggctccctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10204 - RNA, 9873 nt, synthetic construct
  misc_feature 1..9873: note = derived and/or modified CDS sequence (opt1) from DENV-3__EU482596__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10205 - RNA, 9873 nt, synthetic construct
  misc_feature 1..9873: note = derived and/or modified CDS sequence (opt1) from DENV-3__JQ922554__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgcccccacatcaccgagctggagcccgaggacatcgactgctggtgcaacctcaccagcacctgggtgacgtacgggacctgcaaccaggccggcgagcaccggcgcgacaagcggtccgtggccctggccccccacgtcggcatggggctggacacccgcacccagacgtggatgagcgcggagggcgcctggcggcaggtggagaaggtggagacctgggccctccgccacccggggttcaccatcctggccctgttcctcgcgcactacatcggcacctccctgacgcagaaggtcgtgatcttcatcctgctcatgctggtgacccccagcatgaccatgcggtgcgtcggggtgggcaaccgcgacttcgtggagggcctgtccggggccacctgggtcgacgtggtgctcgagcacggcgggtgcgtcacgaccatggccaagaacaagcccaccctggacatcgagctgcagaagaccgaggccacgcagctcgccaccctgcggaagctgtgcatcgagggcaagatcaccaacatcaccacggacagccgctgccccacccagggcgaggcgatcctcccggaggagcaggaccagaactacgtgtgcaagcacacctacgtggaccgggggtggggcaacgggtgcggcctgttcgggaagggctccctggtcacctgcgccaagttccagtgcctcgagagcatcgagggcaaggtggtgcagcacgagaacctgaagtacacggtcatcatcaccgtgcacaccggggaccagcaccaggtgggcaacgagacccagggggtcacggccgagatcacctcccaggccagcaccgccgaggcgatcctgcccgagtacggcaccctcgggctggagtgctccccccgcaccggcctggacttcaacgagatgatcctcctgacgatgaagaacaaggcctggatggtgcaccggcagtggttcttcgacctgcccctcccgtggaccagcggcgccaccaccaagacgcccacctggaaccgcaaggagctgctggtcaccttcaagaacgcccacgccaagaagcaggaggtggtggtcctcgggtcccaggagggcgcgatgcacaccgccctgacgggggccaccgagatccagaccagcggcgggacctccatcttcgccggccacctgaagtgccggctcaagatggacaagctggagctgaagggcatgagctacgccatgtgcctcaacacgttcgtgctgaagaaggaggtgagcgagacccagcacgggaccatcctgatcaaggtcgagtacaagggcgaggacgcgccctgcaagatccccttctccaccgaggacgggcagggcaaggcccacaacggccgcctgatcacggccaacccggtggtgaccaagaaggaggagcccgtcaacatcgaggccgagccccccttcggggagagcaacatcgtgatcggcatcggggacaaggcgctcaagatcaactggtaccggaagggctccagcatcgggaagatgttcgaggccaccgcccgcggcgcccggcgcatggccatcctgggcgacaccgcgtgggacttcgggtccgtgggcggggtcctgaacagcctcggcaagatggtgcaccagatcttcgggtccgcctacacggccctgttcagcggcgtgtcctggatcatgaagatcggcatcggggtcctgctcacctggatcggcctgaacagcaagaacacctccatggccttcagctgcatcgccatcgggatcatcaccctgtacgtgggcgtggtcgtgcaggcggacatggggtgcgtgatcaactggaagggcaaggagctcaagtgcggctccgggatcttcgtcacgaacgaggtgcacacctggaccgagcagtacaagttccaggccgacagcccgaagcgcctggccaccgccatcgccggcgcgtgggagaacggggtgtgcggcatccggtccacgacccgcatggagaacctgctctggaagcagatcgccaacgagctgaactacatcctgtgggagaacaacatcaagctcaccgtcgtggtgggggacatcaccggcgtcctggagcagggcgagcggacgctgaccccccagcccatggagctcaagtacagctggaagacctgggggaaggccaagatcgtgaccgccgagacgcagaactccagcttcatcatcgacggcccctccaccccggagtgccccagcgcgagccgcgcctggaacgtgtgggaggtcgaggactacgggttcggcgtgttcaccaccaacatctggctgaagctgcgggaggtgtacacccagctctgcgaccaccgcctgatgtccgccgccgtcaaggacgagcgggccgtgcacgcggacatgggctactggatcgagagccagaagaacgggtcctggaagctggagaaggccagcctcatcgaggtgaagacgtgcacctggcccaagtcccacaccctgtggagcaacggcgtcctggagtccgacatgatcatccccaagagcctcgccgggccgatctcccagcacaaccaccgccccggctaccacacccagacggccgggccctggcacctgggcaagctggagctcgacttcaactactgcgagggcaccaccgtggtgatcagcgagaactgcgggacccggggcccgtccctgcgcacgaccaccgtcagcgggaagctgatccacgagtggtgctgccggtcctgcaccctcccccccctgcgctacatgggcgaggacgggtgctggtacggcatggagatccggcccatcaacgagaaggaggagaacatggtgaagagcctggcctccgcgggcagcgggaaggtggacaacttcacgatgggcgtcctctgcctggccatcctgttcgaggaggtgatgcgcgggaagttccggaagaagcacatgatcgccggcgtgctcttcaccttcgtcctgctgctctccgggcagatcacctggcgcgacatggcccacaccctgatcatgatcggcagcaacgccagcgaccggatgggcatgggggtgacgtacctggcgctcatcgccaccttcaagatccagccgttcctggccctgggcttcttcctccgcaagctgacctcccgggagaacctgctcctgggggtgggcctggccatggcggccaccctccgcctgcccgaggacatcgagcagatggccaacggcatcgccctggggctcatggccctgaagctgatcacgcagttcgagacctaccagctctggaccgcgctggtcagcctgacctgctccaacacgatcttcaccctcaccgtggcctggcgcaccgccacgctgatcctggccggcatcagcctcctgcccgtgtgccagtccagctccatgcggaagaccgactggctgcccatgaccgtcgccgcgatgggggtgccgcccctccccctgttcatcttcagcctgaaggacaccctcaagcgccggtcctggcccctgaacgagggcgtcatggccgtggggctggtgagcatcctcgcctccagcctgctgcgcaacgacgtcccgatggccggccccctcgtggccggcgggctgctgatcgcgtgctacgtgatcacgggcacctccgccgacctcaccgtcgagaaggccgccgacgtgacctgggaggaggaggccgagcagacgggggtgagccacaacctgatgatcaccgtcgacgacgacggcaccatgcggatcaaggacgacgagaccgagaacatcctgaccgtgctcctgaagacggcgctgctcatcgtgtccgggatcttcccctacagcatccccgccaccctgctggtctggcacacctggcagaagcagacccagcgctccggcgtgctctgggacgtgccgagcccccccgagacgcagaaggccgagctggaggagggcgtctaccggatcaagcagcaggggatcttcggcaagacccaggtgggggtgggcgtccagaaggagggggtgttccacaccatgtggcacgtgacccgcggcgccgtcctgacgcacaacggcaagcggctcgagcccaactgggcgtccgtgaagaaggacctgatcagctacgggggcgggtggcgcctgagcgcccagtgggccaagggcggggagacccaggtgatcgccgtcgagccgggcaagaaccccaagaacttccagaccatgcccggcatcttccagaccacgaccggggagatcggcgccatcgcgctggacttcaagcccgggacctccggcagcccgatcatcaaccgggagggcaaggtggtggggctctacggcaacggggtcgtgaccaagaacggcgggtacgtgtccggcatcgcccagacgaacgccgagctggacggccccacccccgagctggaggaggagatgttcaagaagcgcaacctcaccatcatggacctgcacccggggagcggcaagacccggaagtacctgcccgccatcgtccgcgaggccatcaagcggcgcctccggacgctgatcctggcgcccacccgcgtggtggccgccgagatggaggaggccctcaaggggctgcccatccggtaccagaccaccgccacgaagtccgagcacaccggccgcgagatcgtcgacctgatgtgccacgcgaccttcaccatgcggctcctgagcccggtgcgcgggtccaactacaacctgatcatcatggacgaggcccacttcacggaccccgccagcatcgccgcgatcggctacatctccacccgcgtgggcatgggggaggccgccgccatcttcatgaccgccaccccccccggcacggtcgacgcgttcccgcagagcatcccccccatccaggacgaggagcgggacatccccgagcgctcctggaacagcgggaacgagtggatcaccgacttcgtgggcaagaccgtgtggttcgtcccgtccatcaaggccgggaacgacatcgccaactgcctccggaagaacggcaagaaggtgatccagctgagccgcaagaccttcgacacggagtaccagaagaccaagctgaacgactgggacttcgtggtcaccaccgacatctccgagatgggcgccaacttcaaggccgaccgggtgatctacctccgccggtgcctgaagcccgtgatcctgacgaacgggcccgagcgcgtcatcctcgcgggccccatgccggtgaccgtggccagcgccgcccagcggcgcgggcgggtcggccgcaacccccagaaggagaacgaccagtacatcttcatggggcagcccctgaacaacgacgaggaccacgcccactggaccgaggcgaagatgctgctcgacaacatcaacacccccgagggcatcatcccggccctgttcgagcccgagcgggagaagtccgccgccatcgacggcgagtaccgcctgaagggggagagccggaagaccttcgtggagctcatgcgccggggcgacctgcccgtgtggctggcgcacaaggtcgcctccgaggggatcaagtacacggaccgcaagtggtgcttcgacggcgagcggaacaaccagatcctcgaggagaacatggacgtggagatctggaccaaggagggcgagaagaagaactggcgcccccgctggctggacgcccggacctacagcgacccgctggccctcaaggagttcaaggacttcgccgcggggcgcaagagcatcgccctggacctggtcaccgagatcggccgggtgccctcccacctcgcccacacggtgcgcaacgccctggacaacctggtcatgctccacaccagcgagcacgggggccgggcctaccgccacgcggtggaggagctgcccgagaccatggagaccctgctcctgctggggctcatgatcctgctgacgggcggcgccatgctcttcctgatctccgggaagggcatcgggaagaccagcatcggcctgatctgcgtgatcgcctccagcgggatgctctggatggccgacgtccccctgcagtggatcgcctccgcgatcgtgctggagttcttcatgatggtgctcctgatcccggagcccgagaagcagcggaccccccaggacaaccagctggcctacgtcgtgatcggcatcctcaccctggccgccatcgtggccgcgaacgagatgggcctgctcgagacgaccaagcgcgacctggggatgagcaaggagccgggcgtcgtgtcccccaccagctacctggacgtggacctccaccccgcctccgcctggaccctgtacgccgtcgcgacgcccgtgatcaccccgatgctgcggcacaccatcgagaacagcaccgccaacgtgtccctcgccgccatcgccaaccaggcggtcgtgctgatggggctggacaagggctggcccatcagcaagatggacctcggggtgcccctgctggccctcggctgctactcccaggtcaaccccctgacgctggccgccgccgtgctcctgctggtgacccactacgcgatcatcggcccggggctccaggccaaggccacccgcgaggcccagaagcggaccgccgcgggcatcatgaagaaccccacggtcgacgggatcatgaccatcgacctggaccccgtgatctacgacagcaagttcgagaagcagctgggccaggtgatgctcctggtcctgtgcgccgtgcagctcctgctgatgcgcacctcctggcccctctgcgaggtgctggccctggccaccggcccgatcacgaccctctgggaggggagccccggcaagttctggaacaccaccatcgcggtctccatggccaacatcttccgggggagctacctggccggcgccgggctggccttcagcatcatgaagtccgtgggcacgggcaagcgcgggaccggcagccagggggagaccctcggcgagaagtggaagaagaagctgaaccagctgtcccggaaggagttcgacctctacaagaagagcgggatcaccgaggtggaccgcacggaggcgaaggagggcctgaagcggggcgagatcacccaccacgccgtctcccgcgggagcgccaagctgcagtggttcgtggagcggaacatggtgttccccgagggccgcgtcatcgacctcgggtgcggccgggggggctggtcctactactgcgccggcctgaagaaggtgaccgaggtgcgcgggtacaccaagggcgggcccggccacgaggagccggtccccatgagcacctacgggtggaacatcgtgaagctgatgtccggcaaggacgtgttctacctgccccccgagaagtgcgacacgctcctgtgcgacatcggcgagagctccccgagccccaccgtcgaggagtcccgcaccatccgggtgctgaagatggtggagccctgggtcaagaacaaccagttctgcatcaaggtgctcaacccctacatgccgagcgtgatcgagcacctggagaacctgcagcgcaagcacgggggcatcctcgtccggaaccccctgtcccgcaacagcacccacgagatgtactggatctccaacgggacgggcaacatcgtgagctccgtgaacatggtcagccggctgctcctgaaccgcttcaccatgacccaccggcgccccaccatcgagaaggacgtggacctgggcgccgggacgcggcacgtcaacgcggagcccgagaccccgaacatggacgtgatcggcgagcgcatcaagcggatcaaggaggagcacagctccacctggcactacgacgacgagaacccctacaagacctgggcctaccacgggagctacgaggtgaaggccacgggctccgccagctccatgatcaacggggtcgtgaagctcctgaccaagccctgggacgtggtcccgatggtgacccagatggccatgaccgacacgacccccttcggccagcagcgcgtgttcaaggagaaggtcgacacccggaccccccgccccatgccgggcacgcggaaggtgatggagatcaccgcggagtggctgtggcgcaccctcgggcggaacaagcgcccccggctgtgcacccgcgaggagttcacgaagaaggtgcgcaccaacgccgccatgggcgccgtcttcaccgaggagaaccagtgggacagcgcgcgggccgccgtggaggacgaggagttctggaagctggtggaccgcgagcgggagctccacaagctggggaagtgcggctcctgcgtctacaacatgatggggaagcgcgagaagaagctgggcgagttcggcaaggccaaggacagccgggccatctggtacatgtggctcggggcgcgctacctggagttcgaggccctgggcttcctcaacgaggaccactggttctcccgggagaacagctactccggggtggagggcgaggggctgcacaagctgggctacatcctccgcgacatcagcaagatccccggcggggccatgtacgccgacgacaccgccggctgggacacgcggatcaccgaggacgacctgcacaacgaggagaagatcacccagcagatggcgcgcgagcaccggcagctggccaacgccatcttcaagctcacctaccagaacaaggtggtcaaggtgcagcgccccacgccgaaggggaccgtgatggacatcatctcccggaaggaccagcgcggcagcggccaggtcgggacctacggcctgaacaccttcacgaacatggaggcccagctgatccggcagatggagggggagggcgtgctctccaaggccgacctggagaacccccaccccctggagaagaagatcacccagtggctcgagaccaagggggtggagcgcctgaagcggatggcgatcagcggcgacgactgcgtcgtgaagcccatcgacgaccgcttcgccaacgccctgctcgccctgaacgacatgggcaaggtgcggaaggacatcccgcagtggcagccctccaaggggtggcacgactggcagcaggtccccttctgcagccaccacttccacgagctgatcatgaaggacggccgcaagctcgtggtgccctgccggccgcaggacgagctgctggggaaggcccgcatctcccagggcgcggggtggagcctccgcgagaccgcctgcctgggcaaggcctacgcccagatgtggaccctgatgtacttccaccggcgcgacctccggctggcgagcaacgccatctgctccgccgtccccgtgcactgggtgcccacgagccgcaccacctggtccatccacgcccaccaccagtggatgaccacggaggacatgctgaccgtctggaaccgggtgtggatcgaggacaacccctggatggaggacaagaccccggtgaccacgtgggaggacgtcccctacctcggcaagcgcgaggaccagtggtgcgggagcctgatcggcctgacctcccgggccacctgggcgcagaacatcctcaccgccatccagcaggtgcgcagcctgatcgggaacgaggagttcctggactacatgccctccatgaagcggttccgcaaggaggaggagagcgagggcgccatctggtga

SEQ ID NO: 10206 - RNA, 9873 nt, synthetic construct
  misc_feature 1..9873: note = derived and/or modified CDS sequence (opt1) from DENV-3__EU529683__SS-prME
  source 1..9873: mol_type = other RNA
accagcctctgcctcatgatgatcctgcccgcggcgctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcccggatcgtcaccgccgagacgcagaacagctccttcatcatcgacggccccaacacccccgagtgccccaacaccagccgcgcctggaacgtgtgggaggtggaggactacgggttcggcgtcttcaccaccaacatctggctcaagctgcgggaggtgtacacgcagctgtgcgaccaccgcctcatgtccgcggccgtgaaggacgagcgggccgtccacgccgacatgggctactggatcgagagccagaagaacgggagctggaagctggagaaggcctccctgatcgaggtgaagacctgcacctggcccaagagccacaccctctggtccaacggcgtgctggagagcgacatgatcatccccaagtccctggcggggcccatcagccagcacaactaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcagcgagaaggaggagaacatggtcaagtccctggtgagcgccggctccggggaggtggacaacttcaccatgggcgtcctgtgcctcgccatcctgttcgaggaggtgatgcgcgggaagttcggcaagaagcacatgatcgccggggtgttcttcaccttcgtcctgctcctgagcggccagatcacgtggcgggacatggcgcacaccctgatcatgatcggctccaacgccaccgaccgcatggggatgggcgtgacctacctcgccctgatcgccacgttcaagatccagcccttcctggccctcgggttcttcctgcggaagctgaccagccgcgagaacctcctgctgggcgtgggcctcgcgatggccaccaccctgcagctgcccgaggacatcgagcagatggccaacgggatcgccctcggcctgatggcgctgaagctcatcacgcagttcgagacctaccagctgtggaccgccctgatctccctgacctgcagcaacacgatcttcaccctgaccgtcgcctggcggaccgccacgctgatcctcgccggggtgagcctgctgccggtctgccagtccagctccatgcgcaagaccgactggctccccatgaccgtggcggccatgggcgtgccgcccctcccgctgttcatcttcagcctcaaggacaccctgaagcgccggtcctggcccctgaacgagggggtcatggccgtgggcctcgtgagcatcctggcctccagcctgctccgcaacgacgtccccatggccggccccctggtggccggcgggctgctcatcgcctgctacgtgatcacggggacctccgccgacctgaccgtcgagaaggccgccgacgtgacctgggaggaggaggcggagcagaccggggtgagccacaacctgatgatcacggtcgacgacgacgggaccatgcggatcaaggacgacgagaccgagaacatcctcaccgtgctgctgaagacggccctcctgatcgtgtccggcatcttcccgtacagcatccccgccaccctgctcgtctggcacacctggcagaagcagacccagcgctccggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcgtccgtgaagaaggacctgatcagctacggcgggggctggcgcctctccgcccagtggcagaagggggaggaggtgcaggtcatcgccgtggagcccggcaagaaccccaagaacttccagaccatgcccggcaccttccagaccacgaccggggagatcggcgccatcgcgctggacttcaagcccgggaccagcggctcccccatcatcaaccgggagggcaaggtggtcgggctgtacggcaacggggtggtgaccaagaacggcgggtacgtcagcggcatcgcccagacgaacgccgagccggacggccccacccccgagctggaggaggagatgttcaagaagcgcaacctcaccatcatggacctgcaccccgggagcggcaagacccggaagtacctgccggccatcgtgcgcgaggccatcaagcggcgcctccggacgctgatcctggcgcccacccgcgtggtcgccgccgagatggaggaggccctcaaggggctgcccatccggtaccagaccaccgccacgaagtccgagcacaccggccgcgagatcgtggacctgatgtgccacgcgaccttcaccatgcggctcctgagccccgtgcgcgtcccgaactacaacctgatcatcatggacgaggcccacttcacggaccccgcctccatcgccgcccgggggtacatcagcacccgcgtgggcatgggcgaggcggccgccatcttcatgaccgccacgccgcccgggacggcggacgccttcccgcagtccaacgcccccatccaggacgaggagcgcgacatccccgagcggagctggaactccggcaacgagtggatcaccgacttcgccgggaagaccgtgtggttcgtccccagcatcaaggccggcaacgacatcgcgaactgcctccgcaagaacgggaagaaggtgatccagctgtcccggaagaccttcgacacggagtaccagaagaccaagctgaacgactgggacttcgtggtcaccaccgacatcagcgagatgggcgccaacttcaaggccgaccgcgtgatcgacccgcggcgctgcctcaagcccgtgatcctgaccgacggccccgagcgggtcatcctggccgggcccatgccggtgacggccgcgtccgccgcccagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagtcccgcaagacgttcgtcgagctgatgcggcgcggggacctccccgtgtggctggcccacaaggtcgcgagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctactccgacccgctggccctcaaggagttcaaggacttcgccgccggccgcaagagcatcgcgctggacctggtgacggagatcgggcgcgtccccacccacctcgcccaccggacccgcaacgccctggacaacctggtgatgctccacacctccgagcacggcgggaaggcctaccggcacgccgtggaggagctgcccgagacgatggagaccctgctcctgctgggcctcatgatcctgctgaccgggggcgcgatgctgttcctgatcagcggcaaggggatcggcaagacctccatcgggctgatctgcgtcatcgccagcagcggcatgctctggatggccgagatcccgctgcagtggatcgcctccgccatcgtgctggagttcttcatgatggtgctcctgatccccgagcccgagaagcagcgcacgccccaggacaaccagctggcgtacgtcgtgatcgggatcctcaccctggccgccatcatcgccgccaacgagatgggcctgctcgagaccaccaagcgggacctgggcatgagcaaggagccgggggtggtctcccccacgagctacctggacgtggacctccaccccgcgtccgcctggaccctgtacgccgtggccaccaccgtcatcacgcccatgctgcgccacaccatcgagaacagcaccgcgaacgtgtccctcgccgccatcgccaaccaggccgtggtcctgatgggcctggacaaggggtggccgatcagcaagatggacctcggcgtgcccctgctggcgctcgggtgctactcccaggtgaaccccctgaccctgacggccgccgtcctcctgctgatcacccactacgccatcatcggccccggcctccaggccaaggcgacccgggaggcccagaagcgcaccgccgccgggatcatgaagaacccgacggtggacggcatcatgaccatcgacctggaccccgtgatctacgacagcaagttcgagaagcagctggggcaggtcatgctcctggtgctgtgcgccgtgcagctcctgctgatgcggacctcctgggcgctctgcgaggccctgaccctggccacgggccccatcaccaccctctgggagggcagccccgggaagttctggaacaccaccatcgccgtctccatggcgaacatcttccgcggcagctacctggccggggccggcctggccttctccatcatgaagtccgtggggacgggcaagcggggcaccgggtcccagggcgagaccctcggggagaagtggaagaagaagctgaaccagctgagccgcaaggagttcgacctctacaagaagtccggcatcaccgaggtggaccggacggaggccaaggaggggctgaagcgcggcgagatcacccaccacgcggtcagccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacaccaagggcggccccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgagccgcaactccacgcacgagatgtactggatcagcaacggcaccgggaacatcgtcgcctccgtgaacatggtgagccggctcctgctgaaccgcttcaccatgacccaccggcgcccgacgatcgagaaggacgtcgacctcggcgcgggcacccggcacgtgaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggccaccgggtccgccagctccatgatcaacggcgtggtcaagctgctgaccaagccctgggacgtggtgcccatggtcacccagatggcgatgacggacaccacccccttcgggcagcagcgcgtgttcaaggagaaggtggacacccggacgccgcgcagcatgcccggcacccggcgcgtcatggagatcaccgccgagtggctctggcggaccctgggccgcaacaagaagccccggctgtgcacgcgcgaggagttcaccaagaaggtgcgcaccaacgccgccatgggggcggtgttcaccgaggagaaccagtgggactccgccaaggccgccgtcgaggacgaggacttctggaagctcgtggaccgggagcgcgagctgcacaagctgggcaagtgcgggagctgcgtgtacaacatgatgggcaagcgggagaagaagctcggggagttcggcaaggccaagggcagccgcgcgatctggtacatgtggctgggggcccggtacctggagttcgaggccctcggcttcctgaacgaggaccactggttctcccgcgagaacagctactccggggtcgagggcgaggggctgcacaagctcggctacatcctgcgggacatcagcaagatccccggcggggccatgtacgccgacgacacggcgggctgggacacccgcatcaccgaggacgacctgcacaacgaggagaagatcacccagcagatggacccggagcaccggcagctcgccaacgccatcttcaagctgacctaccagaacaaggtggtgaaggtccagcgccccacgcccaccgggaccgtgatggacatcatctcccggaaggaccagcgcggcagcggccaggtggggacctacggcctgaacacgttcaccaacatggaggcccagctcatccggcagatggagggggagggcgtcctgtccaaggccgacctggagaacccccacctcccggagaagaagatcacccagtggctggagaccaagggggtggagcgcctgaagcggatggcgatcagcggcgacgactgcgtggtcaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcccggatctcccagggcgcggggtggagcctccgcgagacggcctgcctgggcaaggcctacgcccagatgtggtccctgatgtacttccaccgccgggacctccgcctggcgagcaacgccatctgctccgccgtgcccgtccactgggtgccgaccagccggaccacctggtccatccacgcccaccaccagtggatgacgaccgaggacatgctgaccgtgtggaaccgcgtctggatcgaggacaacccctggatggaggacaagacccccgtgacgacctgggagaacgtgccctacctcggcaagcgggaggaccagtggtgcgggagcctgatcggcctgacctcccgcgccacctgggcgcagaacatcccgacggccatccagcaggtccggagcctcatcgggaacgaggagttcctggactacatgcccagcatgaagcgcttccggaaggaggaggagtccgagggcgccatctggtga

SEQ ID NO: 10207 - RNA, 9873 nt, synthetic construct
  misc_feature 1..9873: note = derived and/or modified CDS sequence (opt1) from DENV-3__EU529684__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagaagctcgccaccgccatcgccggcgcctgggagaacggggtgtgcggcatccgcagcacgacccgcatggagaacctgctgtggaagcagatcgcgaacgagctcaactacatcctgtgggagaacaacatcaagctgaccgtggtcgtgggggacatcatcggcgtgctcgagcagggcaagcggaccctgacgccccagccgatggagctgaagtactcctggaagacctgggggaaggccaagatcgtcaccgccgagacccagaacagctccttcatcatcgacggccccaacacgcccgagtgccccagcgcctcccgcgcgtggaacgtgtgggaggtggaggactacgggttcggcgtcttcaccaccaacatctggctcaagctgcgggaggtgtacacccagctgtgcgaccaccgcctcatgagcgccgccgtgaaggacgagcgggccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccgcccgggctaccacacccagaccgccgggccctggcacctcggcaagctggagctggacttcaactactgcgagggcacgaccgtcgtgatcaccgagaactgcgggacccggggccccagcctccgcacgaccaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcggggaggtggacaacttcacgatgggcgtcctgtgcctcgccatcctgttcgaggaggtgatgcgcgggaagttcggcaagaagcacatgatcgcgggggtgttcttcaccttcgtcctgctcctgtccggccagatcacctggcgggacatggcccacaccctgatcatgatcggcagcaacgcctccgaccgcatggggatgggcgtgacgtacctcgccctgatcgccaccttcaagatccagcccttcctggcgctcgggttcttcctgcggaagctgaccagccgcgagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcggacggccaccctgatcctcgcgggggtgagcctgctgccggtctgccagtccagctccatgcgcaagaccgactggctccccatgaccgtggccgccatgggcgtgccgcccctcccgctgttcatcttcagcctcaaggacacgctgaagcggcgctcctggcccctgaacgagggggtcatggccgtgggcctcgtgagcatcctggcctccagcctgctccgcaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcggatcaaggacgacgagaccgagaacatcctcacggtgctgctgaagaccgccctcctgatcgtgtccggcatcttcccgtacagcatccccgccaccctgctcgtctggcacacctggcagaagcagacgcagcgctccggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacgcgcggcgcggtcctcacctacaacgggaagcggctggagcccaactgggcctccgtgaagaaggacctgatcagctacggcgggggctggcgcctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgggagggcaagatcgtggggctgtacggcaacggggtcgtgacgaagaacggcgggtacgtgtccggcatcgcccagaccaacgccgagccggacggccccacccccgagctggaggaggagatgttcaagaagcgcaacctcaccatcatggacctgcaccccgggagcggcaagacgcggaagtacctgccggccatcgtccgcgaggcgatcaagcggcgcctccggaccctgatcctggcccccacccgcgtggtggccgccgagatggaggaggccctcaaggggctgcccatccggtaccagaccacggcgaccaagtccgagcacaccggccgcgagatcgtcgacctgatgtgccacgccaccttcacgatgcggctcctgagccccgtgcgcgtgccgaactacaacctgatcatcatggacgaggcccacttcaccgaccccgcctccatcgccgcgcgggggtacatcagcacccgcgtcggcatgggcgaggccgccgccatcttcatgaccgcgacgccgcccgggaccgccgacgccttcccgcagtccaacgcccccatccaggacgaggagcgggacatccccgagcgcagctggaactccggcaacgagtggatcaccgacttcgccgggaagaccgtgtggttcgtgcccagcatcaaggcgggcaacgacatcgccaactgcctccgcaagaacgggaagaaggtcatccagctgtcccggaagacgttcgacaccgagtaccagaagaccaagctgaacgactgggacttcgtggtgaccacggacatcagcgagatgggcgccaacttcaaggccgaccgcgtcatcgacccgcggcgctgcctcaagcccgtgatcctgaccgacggccccgagcgggtgatcctggccgggcccatgccggtcaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtcgagatctggaccaaggagggcgagaagaagaagctccggccccgctggctggacgcccggacgtactccgacccgctggccctcaaggagttcaaggacttcgccgcgggccgcaagagcatcgccctggacctggtgaccgagatcgggcgcgtgcccacccacctcgcccaccggacccgcacggccctggacaacctggtcatgctccacacctccgagcacggcgggaaggcctaccggcacgcggtggaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcgcacgccccaggacaaccagctggcctacgtggtcatcgggatcctcaccctggccgccatcatcgccgcgaacgagatgggcctgctcgagacgaccaagcgggacctgggcatgagcaaggagccgggggtggtgtcccccaccagctacctggacgtcgacctccaccccgcctccgcctggaccctgtacgccgtggcgacgaccgtgatcacccccatgctgcgccacaccatcgagaacagcacggccaacgtctccctcgccgccatcgccaaccaggcggtggtgctgatgggcctggacaaggggtggccgatcagcaagatggacctcggcgtccccctgctggccctcgggtgctactcccaggtgaaccccctgaccctgaccgccgccgtgctcctgctgatcacccactacgccatcatcggccccggcctccaggcgaaggccacgcgggaggcccagaagcgcaccgccgccgggatcatgaagaacccgaccgtcgacggcatcatgaccatcgacctggaccccgtgatctacgacagcaagttcgagaagcagctgggccaggtgatgctcctggtcctgtgcgcggtgcagctcctgctgatgcggacgtcctgggccctctgcgaggccctgaccctggccaccggccccatcaccacgctctgggagggcagccccgggaagttctggaacaccaccatcgcggtgtccatggccaacatcttccgcggcagctacctggccggggccggcctggccttctccatcatgaagtccgtcgggaccggcaagcggggcaccgggtcccagggcgagacgctcggggagaagtggaagaagaagctgaaccagctgagccgcaaggagttcgacctctacaagaagtccggcatcaccgaggtggaccggaccgaggcgaaggaggggctgaagcgcggcgagatcacccaccacgccgtgtcccggggcagcgccaagctgcagtggttcgtcgagcgcaacatggtgatcccggaggggcgggtgatcgacctcggctgcgggcgcggcgggtggtcctactactgcgccggcctgaagaaggtcacggaggtgcggggctacaccaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccacggtggaggagtcccgcaccatccgggtcctgaagatggtggagccgtggctcaagaacaaccagttctgcatcaaggtgctgaacccctacatgcccaccgtcatcgagcacctggagcgcctccagcgcaagcacggcgggatgctggtgcggaaccccctgagccgcaactccacccacgagatgtactggatcagcaacggcacggggaacatcgtggcctccgtcaacatggtgagccggctcctgctgaaccgcttcaccatgacccaccggcgcccgaccatcgagaaggacgtggacctcggcgcgggcacgcggcacgtcaacgccgagcccgagacccccaacatggacgtgatcggggagcgcatcaagcggatcaaggacgagcacaactccacctggcactacgacgacgagaacccgtacaagacctgggcctaccacggcagctacgaggtgaaggccacggggtccgccagctccatgatcaacggcgtcgtgaagctgctgaccaagccctgggacgtcgtgcccatggtgacccagatggcgatgaccgacacgacccccttcgggcagcagcgcgtcttcaaggagaaggtggacacccggaccccgcgcagcatgcccggcacgcggcgcgtgatgggcatcaccgccgagtggctctggcggaccctggggcgcaacaagaagccccggctgtgcacccgcgaggagttcacgaagaaggtccggaccaacgccgccatgggcgcggtgttcaccgaggagaaccagtgggacagcgccaaggccgccgtggaggacgaggacttctggaagctcgtcgaccgcgagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacaccgcggggtgggacacgcgcatcaccgaggacgacctgcacaacgaggagaagatcacccagcagatggacccggagcaccggcagctcgccaacgccatcttcaagctgacctaccagaacaaggtcgtgaaggtgcagcgccccacccccacgggcaccgtcatggacatcatctcccggaaggaccagcgcggcagcggccaggtgggcacctacgggctgaacaccttcacgaacatggaggcccagctcatccggcagatggagggcgagggggtgctgtccaaggccgacctggagaacccccacctcccggagaagaagatcacccagtggctggagaccaagggcgtcgagcgcctgaagcggatggcgatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcccggatctcccagggggcgggctggagcctccgcgagaccgcctgcctgggcaaggcctacgcccagatgtggtccctgatgtacttccaccggcgcgacctccgcctggcgagcaacgccatctgctccgccgtgcccgtgcactgggtcccgacgagccggaccacctggtccatccacgcccaccaccagtggatgaccacggaggacatgctgaccgtgtggaaccgcgtgtggatcgaggacaacccctggatggaggacaagacccccgtcaccacgtgggagaacgtgccctacctcgggaagcgggaggaccagtggtgcggcagcctgatcgggctgaccagccgcgccacctgggcgcagaacatcccgaccgccatccagcaggtccggtccctcatcggcaacgaggagttcctggactacatgcccagcatgaagcgcttccggaaggaggaggagtccgagggggccatctggtga

SEQ ID NO: 10208 - RNA, 9873 nt, synthetic construct
  misc_feature 1..9873: note = derived and/or modified CDS sequence (opt1) from DENV-3__FJ182015__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatctcccgcaaggaccagcggggcagcggccaggtgggcacctacgggctgaacaccttcaccaacatggaggcccagctcatccgccagatggagggcgagggggtcctgtccaaggccgacctggagaacccccacctcccggagaagaagatcacgcagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcacgacctggtccatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10209 - RNA, 9873 nt, synthetic construct
  misc_feature 1..9873: note = derived and/or modified CDS sequence (opt1) from DENV-3__EU569688__SS-prME
  source 1..9873: mol_type = other RNA
accagcctctgcctcatgatgatcctgcccgccgccctggccttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggccgagcccgaggacatcgactgctggtgcaacctgaccagcacctgggtgacctacgggacgtgcaaccaggccggcgagcaccggcgcgacaagcggagcgtggcgctcgcgccccacgtgggcatggggctggacacccgcacccagacctggatgagcgccgagggcgcctggcgccaggtggagaaggtggagacgtgggcgctgcgccacccggggttcaccatcctcgccctgttcctggcccactacatcggcacctccctcacccagaaggtggtgatcttcatcctgctgatgctcgtgacgcccagcatgaccatgcggtgcgtgggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtctccgccggcagcggggaggtggacaacttcaccatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacacgctgatcatgatcggcagcaacgcctccgaccggatggggatgggcgtcacctacctcgccctgatcgcgaccttcaagatccagcccttcctggccctcgggttcttcctgcgcaagctgaccagccgggagaacctcctgctgggcgtgggcctcgccatggccacgaccctgcagctgcccgaggacatcgagcagatggcgaacgggatcgccctcggcctgatggccctgaagctcatcacccagttcgagacctaccagctgtggacggccctgatcagcctgacctgctccaacaccatcttcaccctgacggtggcctggcgcaccgcgaccctgatcctcgccggggtcagcctgctgccggtgtgccagtccagctccatgcggaagaccgactggctccccatgacggtcgccgccatgggcgtgccgcccctcccgctgttcatcttcagcctcaaggacaccctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgacggtggagaaggcggccgacgtcacctgggaggaggaggccgagcagaccggcgtgagccacaacctgatgatcaccgtggacgacgacgggaccatgcgcatcaaggacgacgagacggagaacatcctcaccgtcctgctgaagaccgccctcctgatcgtgtccggcatcttcccgtacagcatccccgccaccctgctcgtgtggcacacgtggcagaagcagacccagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacacgatgtggcacgtgacccggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcacgttccagaccaccaccggggagatcggcgccatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtccgggaggccatcaagcgccggctccgcaccctgatcctggcccccacccgggtggtggccgccgagatggaggaggcgctcaaggggctgcccatccgctaccagacgaccgccaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtgtggttcgtgcccagcatcaaggccggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccggtggctggacgcccgcacctactccgacccgctggccctcaaggagttcaaggacttcgcggccggccgcaagagcatcgccctggacctggtgaccgagatcgggcgggtgcccacccacctcgcccaccgcacgcggaacgccctggacaacctggtcatgctccacacctccgagcacggcgggaaggcgtaccgccacgccgtggaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagacgaccaagcgcgacctgggcatgagcaaggagccgggggtggtgtcccccaccagctacctggacgtcgacctccaccccgcctccgcctggaccctgtacgcggtggccacgaccgtgatcacccccatgctgcggcacaccatcgagaacagcacggccaacgtctccctcgccgccatcgcgaaccaggccgtggtgctgatgggcctggacaaggggtggccgatcagcaagatggacctcggcgtccccctgctggccctcgggtgctactcccaggtgaaccccctgaccctgaccgccgccgtgctcctgctgatcacccactacgcgatcatcggccccggcctccaggccaaggccacgcgcgaggcccagaagcggaccgccgcggggatcatgaagaacccgaccgtcgacggcatcatgaccatcgacctggaccccgtgatctacgacagcaagttcgagaagcagctgggccaggtgatgctcctggtcctgtgcgccgtgcagctcctgctgatgcgcacgtcctgggccctctgcgaggccctgaccctggcgaccggccccatcaccacgctctgggagggcagccccgggaagttctggaacaccaccatcgccgtgtccatggccaacatcttccggggcagctacctggccggggccggcctggcgttctccatcatgaagtccgtcgggaccggcaagcgcggcaccgggtcccagggcgagacgctcggggagaagtggaagaagaagctgaaccagctgagccggaaggagttcgacctctacaagaagtccggcatcaccgaggtggaccgcaccgaggccaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcacggaggtgcgcggctacaccaagggcgggcccgggcacgaggagcccgtgcccatgagcacctacggctggaacatcgtcaagctgatgtccgggaaggacgtgttctacctcccgcccgagcggtgcgacaccctgctgtgcgacatcggcgagagctcccccagccccacggtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgagccgcaactccacccacgagatgtactggatcagcaacggcacggggaacatcgtggcgtccgtcaacatggtgagccggctcctgctgaaccgcttcaccatgacccaccggcgcccgaccatcgagaaggacgtggacctcggcgccggcacgcggcacgtcaacgccgagcccgagacccccaacatggacgtgatcggggagcgcatcaagcggatcaaggaggagcacaactccacctggcactacgacgacgagaacccgtacaagacctgggcctaccacggcagctacgaggtgaaggccacggggtccgcgagctccatgatcaacggcgtcgtgaagctgctgaccaagccctgggacgtcgtgcccatggtgacccagatggccatgaccgacacgacccccttcgggcagcagcgcgtcttcaaggagaaggtggacacccggaccccgcgcagcatgcccggcacgcggcgcgtgatgggcatcaccgccgagtggctctggcggaccctggggcgcaacaagaagccccggctgtgcacccgcgaggagttcacgaagaaggtccgcaccaacgccgcgatgggcgccgtgttcaccgaggagaaccagtgggacagcgccaaggccgccgtggaggacgaggacttctggaagctcgtcgaccgggagcgcgagctgcacaagctggggaagtgcggctcctgcgtgtacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgcggacgacaccgccgggtgggacacgcgcatcaccgaggacgacctgcacaacgaggagaagatcacccagcagatggacccggagcaccggcagctcgccaacgccatcttcaagctgacctaccagaacaaggtcgtgaaggtgcagcgccccacccccacgggcaccgtcatggacatcatctcccggaaggaccagcgcggcagcggccaggtgggcacctacgggctgaacaccttcacgaacatggaggcccagctcatccggcagatggagggcgagggggtgctgtccaaggcggacctggagaacccccacctcccggagaagaagatcacccagtggctggagaccaagggcgtcgagcgcctgaagcggatggccatcagcggcgacgactgcgtggtgaagcccatcgacgaccgcttcgccaacgccctcctggccctgaacgacatggggaaggtccggaaggacatcccccagtggcagccctccaagggctggcacgactggcagcaggtcccgttctgcagccaccacttccacgagctcatcatgaaggacgggcgcaagctggtggtcccctgccggccccaggacgagctgatcggccgcgcgcggatctcccagggggccggctggagcctccgcgagaccgcctgcctgggcaaggcctacgcgcagatgtggtccctgatgtacttccaccgccgggacctccgcctggccagcaacgccatctgctccgccgtgcccgtgcactgggtcccgacgagccggaccacctggtccatccacgcccaccaccagtggatgaccacggaggacatgctgaccgtgtggaaccgcgtgtggatcgaggacaacccctggatggaggacaagacccccgtcaccacgtgggagaacgtgccctacctcgggaagcgggaggaccagtggtgcggcagcctgatcgggctgaccagccgcgcgacctgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10210 - RNA, 9873 nt, synthetic construct
  misc_feature 1..9873: note = derived and/or modified CDS sequence (opt1) from DENV-3__EU529686__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgagaacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatctcccgcaaggaccagcggggcagcggccaggtgggcacctacgggctgaacaccttcaccaacatggaggcccagctcatccgccagatggagggcgagggggtcctgtccaaggccgacctggagaacagccacctccccgagaagaagatcacgcagtggctggagaccaagggcgtggagcggctgaagcgcatggcgatctccggcgacgactgcgtggtcaagccgatcgacgaccggttcgccaacgccctcctggccctgaacgacatggggaaggtgcgcaaggacatcccccagtggcagcccagcaagggctggcacgactggcagcaggtccccttctgctcccaccacttccacgagctcatcatgaaggacgggcggaagctggtcgtgccgtgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgcccacctcccgcacgacctggagcatccacgcccaccaccagtggatgaccaccgaggacatgctgacggtgtggaaccgggtctggatcgaggacaacccgtggatggaggacaagacccccgtgaccacctgggagaacgtgccctacctcgggaagcgcgaggaccagtggtgcggcagcctgatcgggctgacgtcccgggccacctgggcgcagaacatccccaccgccatccagcaggtccgcagcctcatcggcaacgaggagttcctggactacatgccgtccatgaagcggttccgcaaggaggaggagagcgagggggccatctggtga

SEQ ID NO: 10211 - RNA, 9873 nt, synthetic construct
  misc_feature 1..9873: note = derived and/or modified CDS sequence (opt1) from DENV-3__EU529687__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagaaggacatccccgagcgcagctggaactccggcaacgagtggatcaccgacttcgccgggaagaccgtgtggttcgtccccagcatcaaggcgggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccggacgtactccgacccgctggccctcaaggagttcaaggacttcgccgcgggccgcaagagcatcgccctggacctggtgaccgagatcgggcgcgtcccctcccacctcgcccaccggacccgcaacgccctggacaacctggtgatgctccacaccagcgagcacggcgggaaggcctaccggcacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccaccaagcgggacctgggcatgtccaaggagccgggggtggtcagccccacgtcctacctggacgtggacctccaccccgccagcgcctggaccctgtacgccgtggcgaccaccgtcatcacgcccatgctgcgccacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcggaccagctgggccctctgcgaggccctgaccctggccacgggccccatcaccaccctctgggagggctcccccgggaagttctggaacaccacgatcgcggtcagcatggccaacatcttccgcggctcctacctggccggggccggcctggccttcagcatcatgaagtccgtggggaccggcaagcggggcaccgggagccagggcgagaccctcggggagaagtggaagaagaagctgaaccagctgagccgcaaggagttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgggtgctgaagatggtggagccgtggctcaagaacaaccagttctgcatcaaggtcctgaacccctacatgcccacggtgatcgagcacctggagcgcctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgcgggcacccggcacgtgaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgcgtgttcaaggagaaggtggacacgcggaccccgcgcagcatgcccggcacccggcgcgtcatgggcatcaccgccgagtggctctggcggacgctggggcgcaacaagaagccccggctgtgcacccgcgaggagttcaccaagaaggtgcggaccaacgccgccatgggcgcggtgttcacggaggagaaccagtgggactccgccaaggccgccgtcgaggacgaggacttctggaagctcgtggaccgcgagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctcatccggcagatggagggcgagggggtcctgagcaaggccgacctggagaacccccacctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccggcgcgacctccgcctggcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10212 - RNA, 9873 nt, synthetic construct
  misc_feature 1..9873: note = derived and/or modified CDS sequence (opt1) from DENV-3__KF955449__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcgtcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaagatccccttcagcaccgaggacgggcagggcaaggcgcacaacggccgcctgatcacggccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacaccagcgagcacggcgggaaggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgcgggcacccgccacgtgaacgccgagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggcgatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgggaggagttcaccaagaaggtgcgcaccaacgccgccatgggcgcggtcttcacggaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtggagcggctgaagcgcatggcgatctccggcgacgactgcgtcgtgaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtggtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10213 - RNA, 9873 nt, synthetic construct
  misc_feature 1..9873: note = derived and/or modified CDS sequence (opt1) from DENV-3__FJ373303__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacgtgaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacaccagcgagcacggcgggaaggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacgtggtcaagctgatgagcgggaaggacgtgttctacctcccgcccgagaagtgcgacaccctgctgtgcgacatcggcgagtccagcccctcccccaccgtggaggagagccggaccatccgcgtcctgaagatggtggagccgtggctcaagaacaaccagttctgcatcaaggtgctgaacccctacatgcccacggtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcaccatgacgcaccgccggccgaccatcgagaaggacgtggacctcggcgcgggcacccgccacgtcaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtgaagctgctgaccaagccctgggacgtcgtgcccatggtgacgcagatggcgatgaccgacaccacccccttcgggcagcagcgggtcttcaaggagaaggtggacacgcgcaccccgcggagcatgcccggcacccgccgggtgatgggcatcaccgccgagtggctctggcgcacgctggggcggaacaagaagccccgcctgtgcacccgggaggagttcaccaagaaggtccgcaccaacgccgccatgggcgcggtgttcacggaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10214 - RNA, 9873 nt, synthetic construct
  misc_feature 1..9873: note = derived and/or modified CDS sequence (opt1) from DENV-3__KF955451__SS-prME
  source 1..9873: mol_type = other RNA
accagcctgtgcctcatgatgatcctgcccgcggcgctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcgtgggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgtcgtggtgcaggccgacatggggtgcgtcatcaactggaagggcaaggagctgaagtgcggcagcgggatcttcgtgacgaacgaggtgcacacctggaccgagcagtacaagttccaggccgactcccccaagcgcctcgcgaccgccatcgccggcgcctgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggtctacacccagctgtgcgaccaccggctcatgagcgcggccgtgaaggacgagcgcgccgtgcacgccgacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggcggggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcggggaggtggacaacttcacgatgggcgtgctgtgcctcgccatcctgttcgaggaggtcatgcgggggaagttcggcaagaagcacatgatcgccggggtgttcttcaccttcgtgctgctcctgtccggccagatcacctggcgcgacatggcgcacaccctgatcatgatcggcagcaacgcctccgaccggatggggatgggcgtcacgtacctcgccctgatcgccaccttcaagatccagcccttcctggccctcgggttcttcctgcgcaagctgaccagccgggagaacctcctgctgggcgtgggcctcgcgatggccaccacgctgcagctgcccgaggacgtcgagcagatggccaacgggatcgccctcggcctgatggcgctgaagctcatcacccagttcgagacctaccagctgtggaccgccctgatcagcctcacgtgctccaacaccatcttcaccctgaccgtggcctggcgcacggccaccctgatcctcgccggggtgagcctgctgccggtctgccagtccagctccatgcggaagaccgactggctccccatgaccgtggcggccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggccggccccctggtggccggcgggctgctcatcgcctgctacgtgatcaccgggacctccgccgacctgaccgtcgagaaggccgccgacgtgacgtgggaggaggaggcggagcagaccggggtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgccgtcctcacctacaacgggaagcgcctggagcccaactgggcgtccgtgaagaaggacctgatcagctacggcgggggctggcggctcaacgcccagtggcagaagggggaggaggtgcaggtcatcgccgtggagcccggcaagaaccccaagaacttccagaccatgcccggcaccttccagacgaccaccggggagatcggcgccatcgcgctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctggaggaggagatgttcaagaagcggaacctcaccatcatggacctgcaccccgggtccggcaagacgcgcaagtacctgccggccatcgtgcgggaggccatcaagcgccggctccgcaccctgatcctggcgcccacccgggtggtcgccgccgagatggaggaggccctcaaggggctgcccatccgctaccagaccacggccaccaagagcgagcacaccggccgggagatcgtggacctgatgtgccacgcgaccttcacgatgcgcctcctgtcccccgtgcgggtcccgaactacaacctgatcatcatggacgaggcccacttcaccgaccccgccagcatcgccgcccgcgggtacatctccacccgggtgggcatgggcgaggcggccgccatcttcatgaccgccacgccgcccgggaccgcggacgccttcccgcagagcaacgcccccatccaggacgaggagcgcgacatccccgagcgctcctggaacagcggcaacgagtggatcaccgacttcgccgggaagaccgtgtggttcgtcccctccatcaaggccggcaacgacatcgcgaactgcctccggaagaacgggaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacggccccgagcgcgtcatcctggccgggcccatgccggtgaccgccgcgagcgccgcccagcggcgcggccgggtcgggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgccgccatcgacggcgagtaccgcctgaagggcgagagccggaagaccttcgtggagctgatgcgccgcggggacctccccgtgtggctggcccacaaggtcgcgtccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggacttcgccgccggccgcaagtccatcgcgctggacctggtgaccgagatcgggcgggtccccacccacctcgcccaccgcacccggagcgccctggacaacctggtgatgctccacacgtccgagcacggcgggaaggcctaccgccacgccgtggaggagctgcccgagaccatggagaccctgctcctgctgggcctcatgatcctgctgaccgggggcgcgatgctgttcctgatcagcggcaaggggatcggcaagacgagcatcgggctgatctgcgtcatcgcctccagcggcatgctctggatggccgagatcccgctgcagtggatcgcctccgccatcgtgctggagttcttcatgatggtgctcctgatccccgagcccgagaagcagcggacgccccaggacaaccagctggcgtacgtcgtgatcgggatcctcaccctggccgccatcatcgccgccaacgagatgggcctgctcgagaccacgaagcgcgacctgggcatgagcaaggagccgggggtggtctcccccaccagctacctggacgtggacctccaccccgcgtccgcctggaccctgtacgccgtggccaccacggtcatcacccccatgctgcggcacaccatcgagaacagcaccgcgaacgtgtccctcgccgccatcgccaaccaggccgtggtcctgatgggcctggacaaggggtggccgatcagcaagatggacctcggcgtgcccctgctggcgctcgggtgctactcccaggtgaaccccctgacgctgaccgccgccgtcctcctgctgatcacccactacgccatcatcggccccggcctccaggccaaggcgacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgccgtgcagctcctgctgatgcgcacctcctgggcgctctgcgaggccctgacgctggccaccggccccatcaccaccctctgggagggcagccccgggaagttctggaacacgaccatcgccgtctccatggcgaacatcttccggggcagctacctggccggggccggcctggccttctccatcatgaagtccgtggggaccggcaagcgcggcaccgggtcccagggcgagaccctcggggagaagtggaagcggaagctgaaccagctgagccgcaaggagttcgacctctacaagaagtccggcatcacggaggtggaccggaccgaggccaaggaggggctgaagcgcggcgagatcacccaccacgcggtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccgcacgatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacccacgagatgtactggatcagcaacggcaccgggaacatcgtcgcctccgtgaacatggtgagccggctcctgctgaaccgcttcacgatgacccaccggcgcccgaccatcgagaaggacgtcgacctcggcgccggcacccggcacgtgaacgcggagcccgagacgcccaacatggacgtcatcggggagcgcatcaagcggatcaaggaggagcacaactccacctggcactacgacgacgagaacccgtacaagacctgggcctaccacggcagctacgaggtgaaggccaccgggtccgccagctccatgatcaacggcgtggtcaagctgctgacgaagccctgggacgtggtgcccatggtcacccagatggccatgaccgacaccacgcccttcgggcagcagcgcgtgttcaaggagaaggtggacacccggaccccgcgccccatgcccggcacccggcgcgtcatgggcatcacggcggagtggctctggcggaccctggggcgcaacaagaagccccggctgtgcacccgcgaggagttcaccaagaaggtgcgcacgaacgccgccatgggcgccgtgttcaccgaggagaaccagtgggacagcgcgaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgccgggtgggacacccgcatcacggaggacgacctgcacaacgaggagaagatcacccagcagatggaccccgagcaccggcagctcgcgaacgccatcttcaagctgacctaccagaacaaggtggtgaaggtccagcgccccacccccaccggcacggtgatggacatcatcagccggaaggaccagcgcggctccggccaggtgggcacctacgggctgaacaccttcaccaacatggaggcccagctcatccggcagatggagggcgagggggtcctgagcaaggccgacctggagaacccgcacctctccgagaagaagatcacgcagtggctggagaccaagggcgtggagcgcctgaagcggatggccatcagcggcgacgactgcgtggtcaagcccatcgacgaccgcttcgcgaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggccggctggagcctccgcgagaccgcgtgcctgggcaaggcctacgcccagatgtggtccctgatgtacttccaccgccgggacctccgcctggccagcaacgcgatctgctccgccgtgcccgtccactgggtgccgaccagccggacgacctggtccatccacgcccaccaccagtggatgaccaccgaggacatgctgacggtgtggaaccgcgtctggatcgaggacaacccctggatggaggacaagacccccgtgaccacctgggagaacgtgccctacctcgggaagcgggaggaccagtggtgcggcagcctgatcgggctgacgagccgcgccacctgggcccagaacatcccgaccgcgatccagcaggtccggtccctcatcggcaacgaggagttcctggactacatgcccagcatgaagcgcttccggaaggaggaggagtccgagggggccatctggtga

SEQ ID NO: 10215 - RNA, 9873 nt, synthetic construct
  misc_feature 1..9873: note = derived and/or modified CDS sequence (opt1) from DENV-3__KF955453__SS-prME
  source 1..9873: mol_type = other RNA
accagcctgtgcctcatgatgatcctgcccgcgaccctggccttccacctcaccagccgggacggggagccgcggatgatcgtggggaagaacgagcggggcaagagcctgctgttcaagaccgcgtccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacgtggatgagcgcggagggcgcctggcgccaggtggagaaggtcgagacctgggccctgcgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcggtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggccaccctgcccgagtacggcacgctggggctcgagtgctccccgcgcaccggcctggacttcaacgagatgatcctgctcaccatgaagaacaaggcgtggatggtgcaccggcagtggttcttcgacctgcccctgccctggaccagcggcgccacgaccgagacccccacctggaaccgcaaggagctcctggtgacgttcaagaacgcccacgccaagaagcaggaggtcgtggtgctggggtcccaggagggcgccatgcacaccgcgctcaccggggccaccgagatccagaacagcggcgggacgtccatcttcgccggccacctgaagtgccggctgaagatggacaagctcgagctgaagggcatgagctacgccatgtgcaccaacaccttcgtcctgaagaaggaggtgtccgagacccagcacgggacgatcctcatcaaggtggagtacaagggcgaggacgtcccgtgcaagatccccttcagcaccgaggacgggcagggcaaggcccacaacggccgcctgatcaccgcgaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggccacggcgcggggcgcccgccggatggccatcctgggcgacaccgcctgggacttcgggtccgtgggcggggtcctcaacagcctgggcaagatggtgcaccagatcttcgggtccgcctacaccgcgctgttcagcggcgtgtcctgggtcatgaagatcggcatcggggtgctcctgacctggatcggcctgaacagcaagaacacgtccatgagcttctcctgcatcgccatcgggatcatcaccctctacctgggcgccgtggtccaggccgacatggggtgcgtgatcaactggaagggcaaggagctgaagtgcggcagcgggatcttcgtgaccaacgaggtccacacctggacggagcagtacaagttccaggccgactcccccaagcgcctcgcgaccgccatcgccggcgcctgggagaacggggtgtgcggcatccgcagcaccacccggatggagaacctgctgtggaagcagatcgccaacgagctcaactacatcctgtgggagaacaacatcaagctgacggtggtcgtgggggacatcatcggcgtgctcgagcagggcaagcgcaccctgacgccccagccgatggagctgaagtactcctggaagacctgggggaaggcgaagatcgtcacggccgagacccagaacagctccttcatcatcgacggccccaacacccccgagtgccccagcgcctcccgggcctggaacgtgtgggaggtggaggactacgggttcggcgtcttcaccaccaacatctggctcaagctgcgcgaggtgtacacgcagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacctgcacctggccgaagtcccacaccctctggagcaacggcgtgctggagtccgacatgatcatccccaagagcctggcggggcccatctcccagcacaactaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacgtggcgcgacatggcgcacaccctgatcatgatcggcagcaacgcctccgaccggatggggatgggcgtgacctacctcgccctgatcgccaccttcaagatccagcccttcctggccctcgggttcttcctgcgcaagctgacgagccgggagaacctcctgctgggcgtgggcctcgcgatggccaccaccctgcagctgcccgaggacatcgagcagatggccaacgggatcgccctcggcctgatggcgctgaagctcatcacccagttcgagacgtaccagctgtggaccgccctgatcagcctgacctgctccaacaccatcttcacgctgaccgtcgcctggcgcaccgccaccctgatcctcgccggggtgagcctgctgccggtctgccagtccagctccatgcggaagacggactggctccccatgaccgtggcggccatgggcgtgccgcccctcccgctgttcatcttcaacctcaaggacaccctgaagcgccgcagctggcccctgaacgagggggtcatggccgtgggcctcgtgtccatcctggccagctccctgctccggaacgacgtccccatggccggccccctggtggccggcgggctgctcatcgcctgctacgtgatcaccgggacgagcgccgacctgaccgtcgagaaggccgccgacgtgacctgggaggaggaggcggagcagaccggggtgtcccacaacctgatgatcaccgtcgacgacgacgggacgatgcgcatcaaggacgacgagaccgagaacatcctcaccgtgctgctgaagaccgccctcctgatcgtgagcggcatcttcccgtactccatccccgccacgctgctcgtctggcacacctggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggcgagcgtgaagaaggacctgatctcctacggcgggggctggcggctcagcgcccagtggcagaagggggaggaggtgcaggtcatcgccgtggagcccggcaagaaccccaagaacttccagacgatgcccggcaccttccagaccaccacgggggagatcggcgccatcgcgctggacttcaagcccgggacctccggcagccccatcatcaaccgcgagggcaagatcgtggggctgtacggcaacggggtcgtgaccaagaacggcgggtacgtgagcggcatcgcccagaccaacgccgagccggacggccccacgcccgagctggaggaggagatgttcaagaagcggaacctcaccatcatggacctgcaccccgggtccggcaagacccgcaagtacctgccggccatcgtccgggaggccatcaagcgccggctccgcaccctgatcctggcgcccacgcgggtggtggccgccgagatggaggaggccctcaaggggctgcccatccgctaccagaccaccgccaccaagagcgagcacacgggccgggagatcgtcgacctgatgtgccacgcgaccttcaccatgcgcctcctgtcccccgtgcgggtgccgaactacaacctgatcatcatggacgaggcccacttcaccgaccccgccagcatcgccgcccgcgggtacatctccacgcgggtcggcatgggcgaggcggccgccatcttcatgaccgccacgccgcccgggaccgcggacgccttcccgcagagcaacgcccccatccaggacgaggagcgcgacatccccgagcgctcctggaacagcggcaacgagtggatcacggacttcgccgggaagaccgtgtggttcgtgccctccatcaaggccggcaacgacatcgcgaactgcctccggaagaacgggaagaaggtcatccagctgagccgcaagaccttcgacaccgagtaccagaagacgaagctgaacgactgggacttcgtggtgaccaccgacatctccgagatgggcgccaacttcaaggccgaccgggtcatcgacccgcgccggtgcctcaagcccgtgatcctgaccgacggccccgagcgcgtgatcctggccgggcccatgccggtcaccgccgcgagcgccgcccagcggcgcggccgggtggggcgcaacccccagaaggagaacgaccagtacatcttcacgggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgaagggcgagagccggaagaccttcgtggagctgatgcgccgcggggacctccccgtctggctggcccacaaggtggcgtccgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctacagcgacccgctggccctcaaggagttcaaggacttcgccgccggccgcaagtccatcgcgctggacctggtgaccgagatcgggcgggtgcccacgcacctcgcccaccgcacccggaacgccctggacaacctggtcatgctccacaccagcgagcacggcgggaaggcctaccgccacgccgtggaggagctgcccgagaccatggagacgctgctcctgctgggcctcatgatctccctgaccgggggcgcgatgctgttcctcatcagcggcaaggggatcggcaagaccagcatcgggctgatctgcgtgatcgcctccagcggcatgctgtggatggccgagatcccgctccagtggatcgcctccgccatcgtcctggagttcttcatgatggtgctgctcatccccgagcccgagaagcagcggacgccccaggacaaccagctggcgtacgtggtcatcgggatcctgacgctcgccgccatcatcgccgccaacgagatgggcctgctggagaccaccaagcgcgacctcggcatgagcaaggagccgggggtggtgtcccccaccagctacctggacgtcgacctgcaccccgcgtccgcctggacgctctacgccgtggccaccaccgtgatcacccccatgctgcggcacacgatcgagaacagcaccgcgaacgtctccctggccgccatcgccaaccaggccgtggtgctcatgggcctggacaaggggtggccgatcagcaagatggacctgggcgtccccctcctggcgctggggtgctactcccaggtgaaccccctcaccctgaccgccgccgtgctgctcctgatcacgcactacgccatcatcggccccggcctgcaggccaaggcgacccgcgaggcccagaagcggaccgccgccgggatcatgaagaacccgaccgtcgacggcatcatgacgatcgacctcgaccccgtgatctacgacagcaagttcgagaagcagctgggccaggtgatgctgctcgtcctgtgcgccgtgcagctgctcctgatgcgcacctcctgggcgctgtgcgaggccctcaccctggccaccggccccatcacgaccctgtgggagggcagccccgggaagttctggaacaccaccatcgccgtgtccatggcgaacatcttccggggcagctacctcgccggggccggcctggccttctccatcatgaagtccgtcgggaccggcaagcgcggcacggggtcccagggcgagaccctgggggagaagtggaagaagaagctcaaccagctgagccggaaggagttcgacctgtacaagaagtccggcatcaccgaggtggaccgcaccgaggccaaggaggggctcaagcggggcgagatcacgcaccacgcggtgtcccgcggcagcgccaagctgcagtggttcgtcgagcggaacatggtgatcccggaggggcgcgtgatcgacctgggctgcgggcggggcgggtggtcctactactgcgccggcctcaagaaggtcaccgaggtgcgcggctacaccaagggcgggcccgggcacgaggagcccgtgcccatgagcacctacggctggaacatcgtcaagctgatgtccgggaaggacgtgttctacctgccgcccgagaagtgcgacacgctcctgtgcgacatcggcgagagctcccccagccccaccgtggaggagtcccggaccatccgcgtcctgaagatggtggagccgtggctgaagaacaaccagttctgcatcaaggtgctcaacccctacatgcccaccgtcatcgagcacctggagcgcctgcagcggaagcacggcgggatgctcgtgcgcaaccccctgagccggaactccacgcacgagatgtactggatcagcaacggcaccgggaacatcgtggcctccgtcaacatggtgagccgcctgctcctgaaccggttcaccatgacccaccgccggccgacgatcgagaaggacgtggacctgggcgccggcacccgccacgtcaacgcggagcccgagacccccaacatggacgtgatcggggagcggatcaagcgcatcaaggaggagcacaactccacctggcactacgacgacgagaacccgtacaagacgtgggcctaccacggcagctacgaggtgaaggccaccgggtccgccagctccatgatcaacggcgtcgtgaagctcctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgcggagtggctgtggcgcaccctcgggcggaacaagaagccccgcctgtgcacgcgggaggagttcaccaagaaggtccgcaccaacgccgccatgggcgccgtgttcaccgaggagaaccagtgggacagcgcgaaggccgccgtggaggacgaggacttctggaagctggtcgaccgcgagcgggagctccacaagctggggaagtgcggctcctgcgtgtacaacatgatggggaagcgcgagaagaagctgggcgagttcggcaaggccaaggggagccgggccatctggtacatgtggctcggcgcgcgctacctggagttcgaggccctggggttcctcaacgaggaccactggttctcccgggagaacagctactccggcgtggagggggagggcctgcacaagctgggctacatcctccgcgacatcagcaagatccccgggggcgccatgtacgccgacgacacggccgggtgggacacccggatcaccgaggacgacctgcacaacgaggagaagatcacccagcagatggacccggagcaccgccagctggcgaacgccatcttcaagctcacctaccagaacaaggtcgtgaaggtgcagcggcccacgcccaccggcaccgtcatggacatcatctcccgcaaggaccagcggggcagcggccaggtgggcacctacgggctgaacacgttcaccaacatggaggcccagctgatccgccagatggagggcgagggggtgctctccaaggccgacctggagaacccccacctccccgagaagaagatcacccagtggctggagaccaagggcgtcgagcggctgaagcgcatggccatcagcggcgacgactgcgtggtgaagcccatcgacgaccggttcgcgaacgccctgctcgccctgaacgacatggggaaggtccgcaaggacatcccccagtggcagccctccaagggctggcacgactggcagcaggtcccgttctgcagccaccacttccacgagctgatcatgaaggacgggcggaagctcgtggtcccctgccgcccccaggacgagctgatcggccgggcccgcatctcccagggggccggctggagcctgcgggagacggcgtgcctcggcaaggcctacgcccagatgtggtccctgatgtacttccaccgccgcgacctgcggctcgccagcaacgcgatctgctccgccgtgcccgtgcactgggtcccgaccagccgcaccacctggtccatccacgcccaccaccagtggatgacgaccgaggacatgctgaccgtgtggaaccgggtgtggatcgaggacaacccctggatggaggacaagacccccgtcacgacctgggagaacgtgccctacctggggaagcgcgaggaccagtggtgcggcagcctcatcgggctgaccagccgggccacctgggcccagaacatcccgacggcgatccagcaggtccgctccctgatcggcaacgaggagttcctcgactacatgcccagcatgaagcggttccgcaaggaggaggagtccgagggggccatctggtga

SEQ ID NO: 10216 - RNA, 9873 nt, synthetic construct
  misc_feature 1..9873: note = derived and/or modified CDS sequence (opt1) from DENV-3__FJ373304__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaaggtggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacaccatcggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacgtgcacctggccgaagtcccacaccctctggagcaacggcgtcctggagtccgacatgatcatccccaagagcctggccgggcccatctcccagcacaactaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtcgacaacttcaccatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtcggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtggcctggcgcaccgccaccctgatcctcgcgggggtcagcctgctgccggtgtgccagtccagctccatgcggaagaccgactggctccccatgacggtggccgccatgggcgtgccgcccctcccgctgttcatcttcagcctcaaggacaccctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgacggtggagaaggccgcggacgtgacctgggaggaggaggccgagcagaccggcgtcagccacaacctgatgatcaccgtggacgacgacgggaccatgcgcatcaaggacgacgagacggagaacatcctcaccgtgctgctgaagaccgccctcctgatcgtctccggcatcttcccgtacagcatccccgccaccctgctcgtgtggcacacgtggcagaagcagacccagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacacgatgtggcacgtcacccggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtcgtggggctgtacggcaacggggtggtcaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtcgtggccgccgagatggaggaggccctcaaggggctgcccatccgctaccagacgaccgcgaccaagtccgagcacaccggccgggagatcgtggacctgatgtgccacgccacgttcaccatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtctggttcgtgcccagcatcaaggcgggcaacgacatcgccaactgcctccggaagaacgggaagaaggtgatccagctgtcccgcaagaccttcgacaccgagtaccagaagaccaagctgaacgactgggacttcgtcgtgacgaccgacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtcaccgagatcgggcgggtgcccacccacctcgcccaccgcacgcggaacgccctggacaacctggtgatgctccacacctccgagcacggcgggaaggcctaccgccacgcggtcgaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcctccgcgatcatcctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagacgaccaagcgcgacctgggcatgagcaaggagccgggggtggtctcccccaccagctacctggacgtggacctccaccccgcctccgcctggaccctgtacgccgtggcgacgaccgtcatcacccccatgctgcggcacaccatcgagaacagcacggccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgaccgccgccgtcctcctgctgatcacccactacgccatcatcggccccggcctccaggcgaaggccacgcgcgaggcccagaagcggaccgccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacgtcctgggccctctgcgaggccctgaccctggccaccggccccatcaccacgctctgggagggcagccccgggaagttctggaacaccaccatcgcggtctccatggccaacatcttccggggcagctacctggccggggccggcctggccttctccatcatgaagtccgtggggaccggcaagcgcggcaccgggtcccagggcgagacgctcggggagaagtggaagaagaagctgaaccagctgagccggaaggagttcgacctctacaagaagtccggcatcaccgaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgacggaggtgcgcggctacaccaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccacggtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcacggggaacatcgtcgcctccgtgaacatggtgagccgcctcctgctgaaccggttcaccatgacccaccgccggccgaccatcgagaaggacgtcgacctcggcgcgggcacgcgccacgtgaacgccgagcccgagacccccaacatggacgtgatcggggagcggatcaagcgcatcaaggaggagcacaactccacctggcactacgacgacgagaacccgtacaagacctgggcctaccacggcagctacgaggtcaaggccacggggtccgccagctccatgatcaacggcgtggtcaagctgctgaccaagccctgggacgtggtgcccatggtcacccagatggcgatgaccgacacgacccccttcgggcagcagcgggtgttcaaggagaaggtggacacccgcaccccgcggagcatgcccggcacgcgccgggtcatgggcatcaccgccgagtggctctggcgcaccctggggcggaacaagaagccccgcctgtgcacccgggaggagttcacgaagaaggtgcgcaccaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtggtgaaggtccagcggcccacccccacgggcaccgtgatggacatcatctcccgcaaggaccagcggggcagcggccaggtgggcacctacgggctgaacaccttcacgaacatggaggcccagctcatccgccagatggagggcgagggggtcctgtccaaggccgacctggagaacccccacctcccggagaagaagatcacccagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgacgagccgcaccacctggtccatccacgcccaccaccagtggatgaccacggaggacatgctgaccgtgtggaaccgggtctggatcgaggacaacccctggatggaggacaagacccccgtgaccacgtgggagaacgtgccctacctcgggaagcgcgaggaccagtggtgcggcagcctgatcgggctgaccagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10217 - RNA, 9873 nt, synthetic construct
  misc_feature 1..9873: note = derived and/or modified CDS sequence (opt1) from DENV-3__EU854291__SS-prME
  source 1..9873: mol_type = other RNA
accagcctctgcctcatgatgatcctgcccgccgccctggcgttccacctcacctcccgggacggcgagccgcggatgatcgtggggaagaacgagcggggcaagagcctgctgttcaagaccgcctccgggatcaacatgtgcaccctcatcgccatggacctgggcgagatgtgcgacgacaccatcacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtcggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtcgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcgcacaacggccgcctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggccgacatggggtgcgtcatcaactggaagggcaaggagctgaagtgcggcagcgggatcttcgtgacgaacgaggtgcacacctggaccgagcagtacaagttccaggcggactcccccaagcgcctcgccaccgccatcgccggcgcctgggagaacggggtctgcggcatccgcagcacgacccggatggagaacctgctgtggaagcagatcgcgaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcctcccgggcgtggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgccgacatgggctactggatcgagagccagaagaacgggtcctggaagctggagaaggcgagcctgatcgaggtcaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtggtcatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccgtgtccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggctccgagcgcgtcatcctggccgggcccatgcccgtgaccgcggccagcgccgcccagcggcgcggccgggtggggcgcaacccgcagaaggagaacgaccagtacatcttcaccggccagcccctcaacaacgacgaggaccacgcccactggacggaggcgaagatgctgctggacaacatcaacacccccgaggggatcatccccgccctcttcgagccggagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctacagcgaccccctggccctcaaggagttcaaggacttcgccgcgggccgcaagtccatcgccctggacctggtgaccgagatcgggcgggtcccgacccacctcgcccaccgcacgcggaacgccctggacaacctggtgatgctccacaccagcgagcacggcgggaaggcctaccgccacgcggtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggccgagatccccctgcagtggatcgccagcgcgatcgtgctggagttcttcatgatggtgctcctgatcccggagcccgagaagcagcggacgccccaggacaaccagctggcctacgtcgtgatcgggatcctcaccctggccgccacgatcgccgcgaacgagatgggcctgctcgagaccaccaagcgcgacctgggcatgtccaaggagcccggggtggtcagcccgacctcctacctggacgtggacctccaccccgccagcgcctggacgctgtacgccgtggcgaccaccgtcatcacccccatgctgcggcacacgatcgagaactccaccgccaacgtgagcctcgccgccatcgccaaccaggcggtggtcctgatgggcctggacaaggggtggcccatctccaagatggacctcggcgtgccgctgctggccctcgggtgctacagccaggtgaaccccctgaccctgaccgccgccgtcctcctgctgatcacgcactacgccatcatcggccccggcctccaggcgaaggccacccgcgaggcccagaagcggaccgccgccgggatcatgaagaaccccaccgtggacggcatcatgacgatcgacctggacccggtgatctacgactccaagttcgagaagcagctggggcaggtcatgctcctggtgctgtgcgcggtgcagctcctgctgatgcgcaccagctgggccctctgcgaggccctgaccctggccaccggccccatcacgaccctctgggagggctcccccgggaagttctggaacaccaccatcgcggtcagcatggccaacatcttccggggctcctacctggccggggccggcctggccttcagcatcatgaagtccgtggggaccggcaagcgcggcacggggagccagggcgagaccctcggggagaagtggaagaagaagctgaaccagctgagccggaaggagttcgacctctacaagaagtccggcatcaccgaggtggaccgcaccgaggcgaaggaggggctgaagcggggcgagatcacgcaccacgccgtcagccgcggctccgccaagctgcagtggttcgtggagcggaacatggtgatccccgaggggcgcgtcatcgacctcggctgcgggcggggcgggtggagctactactgcgccggcctgaagaaggtgaccgaggtgcgcggctacaccaagggcgggccggggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccggaccatccgcgtgctgaagatggtggagccctggctcaagaacaaccagttctgcatcaaggtcctgaacccctacatgcccaccgtgatcgagcacctggagcgcctccagcggaagcacggcgggatgctggtgcgcaaccccctgtcccggaacagcacgcacgagatgtactggatctccaacggcaccgggaacatcgtcgccagcgtgaacatggtgtcccgcctcctgctgaaccggttcaccatgacccaccgccggcccacgatcgagaaggacgtcgacctcggcgcgggcacccgccacgtgaacgccgagccggagacccccaacatggacgtgatcggggagcggatcaagcgcatcaaggaggagcacaacagcacctggcactacgacgacgagaacccctacaagacgtgggcctaccacggctcctacgaggtcaaggccaccgggagcgcctccagcatgatcaacggcgtggtcaagctgctgaccaagccgtgggacgtggtgcccatggtcacccagatggcgatgacggacaccacccccttcgggcagcagcgggtgttcaaggagaaggtggacacccgcacgccccggccgatgcccggcacccgccgggtcatgggcatcaccgccgagtggctctggcgcaccctggggcggaacaagaagccccgcctgtgcacgcgggaggagttcaccaagaaggtgcgcaccaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacctaccagaacaaggtggtgaaggtccagcggcccacgcccaccggcaccgtgatggacatcatctcccgcaaggaccagcggggcagcggccaggtgggcacctacgggctgaacacgttcaccaacatggaggcccagctcatccgccagatggagggcgagggggtcctgtccaaggccgacctggagaacccccacctcccggagaagaagatcacccagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagacggcctgcctgggcaaggcctacgcccagatgtggtccctgatgtacttccaccgccgcgacctccggctggcgagcaacgccatctgctccgccgtgcccgtccactgggtgccgaccagccgcaccacctggtccatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggcagcctgatcgggctgaccagccgggccacctgggcgcagaacatcccgacggccatccagcaggtccgctccctcatcggcaacgaggagttcctggactacatgcccagcatgaagcggttccgcaaggaggaggagtccgagggggccatctggtga

SEQ ID NO: 10218 - RNA, 9873 nt, synthetic construct
  misc_feature 1..9873: note = derived and/or modified CDS sequence (opt1) from DENV-3__KF955454__SS-prME
  source 1..9873: mol_type = other RNA
accagcctgtgcctcatgatgatcctgcccgccgccctggcgttccacctcacctcccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgggacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagggggacatgatcatccccaagtccctggccggccccatcagccagcacaactaccggccggggtaccacacccagaccgccggcccctggcacctcggcaagctggagctggacttcaactactgcgaggggacgaccgtcgtgatcaccgagaactgcggcacccgcgggccctccctccggacgaccaccgtgagcggcaagctgatccacgagtggtgctgccgctcctgcaccctgcccccgctccggtacatgggggaggacggctgctggtacggcatggagatccgccccatcagcgagaaggaggagaacatggtcaagtccctggtgagcgccgggtccggcgaggtggacaacttcacgatgggggtcctgtgcctcgccatcctgttcgaggaggtgatgcggggcaagttcgggaagaagcacatgatcgcgggcgtgttcttcaccttcgtcctgctcctgagcggccagatcacctggcgcgacatggcccacaccctgatcatgatcgggtccaacgccagcgaccggatgggcatgggggtgacgtacctcgccctgatcgccaccttcaagatccagcccttcctggcgctcggcttcttcctgcgcaagctgacctcccgggagaacctcctgctgggcgtggggctcgccatggccaccacgctgcagctgcccgaggacatcgagcagatggccaacggcatcgcgctcgggctgatggccctgaagctcatcacccagttcgagacctaccagctgtggaccgccctgatcagcctcacgtgcagcaacaccatcttcaccctgaccgtcgcctggcgcacggccaccctgatcctcgcgggcgtgtccctgctgccggtctgccagagctccagcatgcggaagaccgactggctccccatgaccgtggccgccatgggggtgccgcccctgccgctgttcatcttctccctcaaggacacgctgaagcgccgcagctggcccctgaacgagggcgtcatggccgtgggcctcgtgtccatcctggccagctccctgctccggaacgacgtccccatggcggggcccctggtggccggcgggctgctcatcgcctgctacgtgatcaccggcaccagcgccgacctgaccgtcgagaaggccgcggacgtgacgtgggaggaggaggccgagcagaccggggtgtcccacaacctgatgatcaccgtcgacgacgacggcaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggggtgctgtgggacgtgcccagcccgcccgagacccagaaggccgagctggaggagggcgtctaccgcatcaagcagcaggggatcttcggcaagacccaggtgggggtgggcgtccagaaggagggcgtgttccacaccatgtggcacgtgacgcgcggggcggtcctcacctacaacggcaagcgcctggagcccaactgggccagcgtgaagaaggacctgatctcctacgggggcgggtggcggctcagcgcccagtggcagaagggcgaggaggtgcaggtcatcgccgtggagcccggcaagaaccccaagaacttccagaccatgcccgggaccttccagacgaccaccggcgagatcggggcgatcgccctggacttcaagcccggcacctccggcagccccatcatcaaccgcgaggggaaggtggtcggcctgtacgggaacggcgtggtgacgaagaacgggggctacgtcagcggcatcgcccagaccaacgccgagccggacgggcccacccccgagctggaggaggagatgttcaagaagcggaacctcaccatcatggacctgcaccccggctccgggaagacgcgcaagtacctgccggccatcgtgcgggaggcgatcaagcgccggctccgcaccctgatcctggcccccacccgggtggtcgccgccgagatggaggaggccctcaagggcctgcccatccgctaccagaccacggcgaccaagagcgagcacaccgggcgggagatcgtggacctgatgtgccacgccaccttcacgatgcgcctcctgtcccccgtgcgggtcccgaactacaacctgatcatcatggacgaggcccacttcaccgaccccgccagcatcgccgcgcgcggctacatctccacccgggtgggcatgggggaggccgccgccatcttcatgaccgcgacgccgcccggcaccgccgacgccttcccgcagagcaacgcccccatccaggacgaggagcgcgacatccccgagcgctcctggaacagcgggaacgagtggatcaccgacttcgccggcaagaccgtgtggttcgtcccctccatcaaggcggggaacgacatcgccaactgcctccggaagaacggcaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacgggcccgagcgcgtcatcctggccggccccatgccggtgaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacgcccgagggcatcatcccggccctcttcgagcccgagcgggagaagtccgccgccatcgacggcgagtaccgcctgaagggggagagccggaagaccttcctggagctcatgcgccggggcgacctgcccgtctggctggcgtacaaggtggcctccgaggggatcaagtacaccgaccgcaagtggtgcttcgacggccagcggaacaaccagatcctcgaggagaacatggacgtcgagatctggaccaaggagggcgagaagaagaagctgcgcccccggtggctggacgcccgcacgtacagcgacccgctcgccctgaaggagttcaaggacttcgccgcggggcgcaagtccatcgccctggacctcgtgaccgagatcggccgggtgcccacccacctggcccaccgcacccggaacgccctggacaacctcgtcatgctgcacacgagcgagcacgggggcaaggcctaccgccacgcggtggaggagctgcccgagaccatggagaccctcctgctgctcgggctgatgatcctgctcaccggcggcgccatgctgttcctgatctccgggaagggcatcgggaagacgagcatcggcctcatctgcgtgatcgccagctccgggatgctgtggatggccgagatcccgctgcagtggatcgccagcgcgatcgtcctcgagttcttcatgatggtgctgctgatccccgagcccgagaagcagcggacgccccaggacaaccagctcgcctacgtggtcatcggcatcctgaccctggccgccatcatcgccgcgaacgagatgggcctcctggagaccacgaagcgcgacctggggatgtccaaggagccgggcgtggtgagccccacctcctacctcgacgtcgacctgcaccccgccagcgcctggaccctgtacgccgtggcgaccacggtgatcacccccatgctccggcacaccatcgagaactccaccgccaacgtcagcctggccgccatcgccaaccaggcggtggtgctgatggggctcgacaagggctggccgatctccaagatggacctgggggtccccctgctcgccctgggctgctacagccaggtgaaccccctgacgctcaccgccgccgtgctgctgctcatcacccactacgccatcatcggccccgggctgcaggcgaaggccacccgcgaggcccagaagcggacggccgccggcatcatgaagaacccgaccgtcgacgggatcatgaccatcgacctggaccccgtgatctacgactccaagttcgagaagcagctcggccaggtgatgctgctggtcctctgcgcggtgcagctgctgctcatgcgcaccagctgggccctgtgcgaggccctgacgctcgccaccggccccatcaccaccctgtgggaggggtcccccggcaagttctggaacacgaccatcgcggtgagcatggccaacatcttccgggggtcctacctggccggcgccgggctcgccttcagcatcatgaagtccgtcggcaccggcaagcgcgggaccggcagccagggggagaccctgggcgagaagtggaagaagaagctgaaccagctctcccggaaggagttcgacctgtacaagaagtccgggatcacggaggtggaccgcgcggaggccaaggagggcctgaagcggggcgagatcacccaccacgccgtgagccgcgggtccgccaagctccagtggttcgtcgagcggaacatggtgatcccggagggccgcgtgatcgacctggggtgcggccgcgggggctggagctactactgcgccggcctgaagaaggtcaccgaggtgcgcgggtacaccaagggcgggcccggccacgaggagcccgtgcccatgtccacgtacgggtggaacatcgtcaagctcatgagcggcaaggacgtgttctacctgccgcccgagaagtgcgacaccctgctgtgcgacatcggcgagtccagcccctcccccaccgtggaggagagccggaccatccgcgtcctcaagatggtggagccgtggctgaagaacaaccagttctgcatcaaggtgctgaacccctacatgcccacggtcatcgagcacctcgagcgcctgcagcggaagcacgggggcatgctggtgcgcaaccccctctcccggaacagcacccacgagatgtactggatctccaacgggaccggcaacatcgtggcgagcgtcaacatggtgtcccgcctgctgctcaaccggttcaccatgacgcaccgccggccgaccatcgagaaggacgtggacctgggcgccgggacccgccacgtcaacgccgagcccgagacccccaacatggacgtgatcggcgagcggatcaagcgcatcaaggaggagcacaacagcacgtggcactacgacgacgagaacccgtacaagacctgggcctaccacgggtcctacgaggtgaaggccaccggcagcgcgtccagcatgatcaacggggtcgtgaagctgctcaccaagccctgggacgtcgtgcccatggtgacgcagatggccatgaccgacaccacccccttcggccagcagcgggtcttcaaggagaaggtggacacgcgcaccccgcggtccatgcccggcacccgccgggtgatggggatcaccgccgagtggctgtggcgcacgctgggccggaacaagaagccccgcctctgcacccgggaggagttcaccaagaaggtccgcaccaacgccgcgatgggggccgtgttcacggaggagaaccagtgggacagcgccaaggccgccgtggaggacgaggacttctggaagctggtcgaccgcgagcgggagctgcacaagctcggcaagtgcgggagctgcgtgtacaacatgatgggcaagcgcgagaagaagctgggcgagttcgggaaggcgaagggctcccgggccatctggtacatgtggctgggggcccgctacctcgagttcgaggccctgggcttcctgaacgaggaccactggttcagccgggagaactcctacagcggggtggagggcgagggcctccacaagctggggtacatcctgcgcgacatctccaagatccccggcggggccatgtacgcggacgacaccgccggctgggacacccggatcaccgaggacgacctccacaacgaggagaagatcacgcagcagatggacccggagcaccgccagctggccaacgccatcttcaagctgacctaccagaacaaggtcgtgaaggtgcagcggcccacccccaccggcaccgtcatggacatcatcagccgcaaggaccagcgggggtccggccaggtggggacgtacggcctcaacaccttcaccaacatggaggcccagctgatccgccagatggagggggagggcgtgctgagcaaggcggacctcgagaacccccacccgcccgagaagaagatcacccagtggctggagacgaagggcgtcgagcggctgaagcgcatggccatctccggggacgactgcgtggtgaagcccatcgacgaccggttcgccaacgccctcctggccctgaacgacatgggcaaggtccgcaaggacatcccccagtggcagccgagcaaggggtggcacgactggcagcaggtccccttctgctcccaccacttccacgagctcatcatgaaggacggccggaagctggtggtcccctgccgcccccaggacgagctgatcgggcgggcgcgcatcagccagggcgccggctggtccctccgggagaccgcctgcctggggaaggcctacgcgcagatgtggagcctgatgtacttccaccgccgcgacctccggctggcctccaacgccatctgcagcgccgtgccggtgcactgggtccccacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccgtacctcggcaagcgcgaggaccagtggtgcgggtccctgatcggcctgaccagccgggcgacgtgggcccagaacatccccaccgccatccagcaggtccgcagcctcatcgggaacgaggagttcctggactacatgccctccatgaagcggttccgcaaggaggaggagagcgagggcgccatctggtga

SEQ ID NO: 10219 - RNA, 9873 nt, synthetic construct
  misc_feature 1..9873: note = derived and/or modified CDS sequence (opt1) from DENV-3__EU854292__SS-prME
  source 1..9873: mol_type = other RNA
accagcctgtgcctcatgatgatcctgcccgcggccctggcgttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtggggatcggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgccctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagcacgagaacctcaagtacaccgtcatcatcacggtgcacaccggggaccagcaccaggtgggcaacgagacccagggggtcaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgcgaagaagcaggaggtggtggtcctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtgtccgagacccagcacgggaccatcctcatcaaggtcgagtacaagggcgaggacgccccgtgcaagatccccttcagcaccgaggacgggcagggcaaggcccacaacggccgcctgatcacggccaaccccgtggtgaccaagaaggaggagcccgtcaacatcgaggcggagccgcccttcggggagagcaacatcgtgatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtcctcaacagcctgggcaagatggtgcaccagatcttcgggtccgcctacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgcggtggtccaggccgacatggggtgcgtgatcaactggaagggcaaggagctgaagtgcggcagcgggatcttcgtgacgaacgaggtccacacctggaccgagcagtacaagttccaggccgactcccccaagcgcctcgccaccgccatcgcgggcgcctgggagaacggggtgtgcggcatccgcagcacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgcggagacccagaacagctccttcatcatcgacggccccaacacgcccgagtgccccagcgccgcccgggcctggaacgtgtgggaggtggaggactacgggttcggcgtcttcaccaccaacatctggctcaagctgcgcgaggtgtacacccagctgtgcgaccaccggctcatgtccgccgcggtgaaggacgagcgcgccgtccacgccgacatgggctactggatcgagagccagaagaacgggagctggaagctggagaaggcctccctgatcgaggtgaagacctgcacgtggcccaagagccacaccctctggtccaacggcgtgctggagagcgacatgatcatccccaagtccctggccgggcccatcagccagcacaaccaccggccgggctaccacacccagaccgcggggccctggcacctcggcaagctggagctggacttcaactactgcgagggcacgaccgtcgtgatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccgggaaggtggacaacttcacgatgggcgtcctgtgcctcgccatcctgttcgaggaggtgatgcgggggaagttcggcaagaagcacatgatcgccggggtgttcttcaccttcgtcctgctcctgagcggccagatcacctggcgcgacatggcccacaccctgatcatgatcggctccaacgcgagcgaccggatggggatgggcgtgacgtacctcgccctgatcgccaccttcaagatccagcccttcctggccctcgggttcttcctgcgcaagctgacctcccgggagaacctcctgctgggcgtgggcctcgcgatggccaccacgctgcagctgcccgaggacatcgagcagatggccaacgggatcgccctcggcctgatggccctgaagctcatcacccagttcgagacctaccagctgtggaccgcgctgatcagcctcacgtgcagcaacaccatcttcaccctgaccgtcgcctggcgcacggccaccctgatcctcgccggggtgtccctgctgccggtgtgccagagctccagcatgcggaagaccgactggctccccatggccgtcgcggccatgggcgtgccgcccctcccgctgttcatcttctgcctcaaggacaccctgaagcgccgctcctggcccctgaacgagggggtcatggccgtgggcctcgtgagcatcctggcctccagcctgctccggaacgacgtccccatggccggccccctggtggccggcgggctgctcatcgcctgctacgtgatcacggggacctccgccgacctgaccgtcgagaaggccgccgacatcacctgggaggaggaggcggagcagacgggggtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgcggtgctcacgtacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagaccacgaccggggagatcggcgccatcgcgctggacttcaagcccgggaccagcggctcccccatcatcaaccgcgagggcaaggtggtggggctgtacggcaacggggtcgtgaccaagaacggcgggtacgtgagcggcatcgcccagacgaacgccgagccggacggccccacccccgagctggaggaggagatgttcaagaagcggaacctcaccatcatggacctgcaccccgggagcggcaagacccgcaagtacctgccggccatcgtccgggaggccatcaagcgccggctccgcacgctgatcctggcgcccacccgggtggtggccgccgagatggaggaggccctcaaggggctgcccatccgctaccagaccaccgccacgaagtccgagcacaccggccgggagatcgtcgacctgatgtgccacgcgaccttcaccatgcgcctcctgagccccgtgcgggtgccgaactacaacctgatcatcatggacgaggcccacttcacggaccccgcctccatcgccgcgcgcgggtacatcagcacccgggtcggcatgggcgaggccgccgccatcttcatgaccgccacgccgcccgggacggcggacgccttcccgcagtccaacgcccccatccaggacgaggagcgcgacatccccgagcgcagctggaactccggcaacgagtggatcaccgacttcgccgggaagaccgtgtggttcgtgcccagcatcaaggccggcaacgacatcgcgaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgccgcgtccgccgcccagcggcgcggccgggtggggcgcaacccccacaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagtcccggaagacgttcgtggagctgatgcgccgcggggacctccccgtctggctggcccacaaggtggcgagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctactccgacccgctggccctcaaggagttcaaggacttcgccgccggccgcaagagcatcgcgctggacctggtcacggagatcgggcgggtgccctcccacctcgcccaccgcacccggaacgccctggacaacctggtcatgctccacaccagcgagcacggcgggcgcgcctaccggcacgccgtggaggagctgcccgagaccatggagacgctgctcctgctgggcctcatgatcctgctgaccgggggcgcgatgctgttcctgatctccggcaaggggatcggcaagaccagcatcgggctgatctgcgtgatcgccagctccggcatgctctggatggccgagatcccgctgcagtggatcgccagcgccatcgtcctggagttcttcatgatggtgctcctgatccccgagcccgagaagcagcgcacgccccaggacaaccagctggcgtacgtggtcatcgggatcctcacgctggccgccatcatcgccgcgaacgagatgggcctgctcgagaccaccaagcgggacctgggcatgtccaaggagccgggggtggtgagccccacctcctacctggacgtcgacctccaccccgccagcgcctggacgctgtacgccgtggccaccaccgtgatcacccccatgctgcgccacacgatcgagaactccaccgcgaacgtcagcctcgccgccatcgccaaccaggccgtggtgctgatgggcctggacaaggggtggccgatctccaagatggacctcggcgtccccctgctggcgctcgggtgctacagccaggtgaaccccctgaccctgaccgccgccgtgctcctgctgatcacgcactacgccatcatcggccccggcctccaggccaaggcgacccgggaggcccagaagcgcaccgccgccgggatcatgaagaacccgaccgtcgacggcatcatgacgatcgacctggaccccgtgatctacgactccaagttcgagaagcagctgggccaggtgatgctcctggtcctgtgcgcggtgcagctcctgctgatgcggaccagctgggccctctgcgaggccctgaccctggccaccggccccatcacgaccctctgggagggctcccccgggaagttctggaacaccaccatcgccgtgagcatggcgaacatcttccgcggctcctacctggccggggccggcctggccttcagcatcatgaagtccgtcgggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagatcacgcaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacgcacgagatgtactggatctccaacggcaccgggaacatcgtggccagcgtcaacatggtgtcccggctcctgctgaaccgcttcaccatgacccaccggcgcccgacgatcgagaaggacgtggacctcggcgccggcacccggcacgtcaacgcggagcccgagacccccaacatggacgtgatcggggagcgcatcaagcggatcaaggaggagcacaacagcacctggcactacgacgacgagaacccgtacaagacgtgggcctaccacggctcctacgaggtgaaggccaccgggagcgcctccagcatgatcaacggcgtcgtgaagctgctgaccaagccctgggacgtggtccccatggtgacccagatggcgatgacggacaccacccccttcgggcagcagcgcgtcttcaaggagaaggtggacacccggacgccgcgctccatgcccggcacccggcgcgtgatgggcatcaccgccgagtggctctggcggaccctggggcgcaacaagaagccccggctgtgcacgcgcgaggagttcaccaagaaggtccgcaccaacgccgccatgggcgccgtgttcaccgaggagaaccagtgggacagcgcgaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacacggccgggtgggacacccgcatcaccgaggacgacctgcacaacgaggagaagatcacccagcagatggacccggagcaccggcagctcgcgaacgccatcttcaagctgacgtaccagaacaaggtcgtgaaggtgcagcgccccacccccaccggcaccgtcatggacatcatcagccggaaggaccagcgcggctccggccaggtgggcacctacgggctgaacacgttcaccaacatggaggcccagctcatccggcagatggagggcgagggggtgctgagcaaggccgacctggagaacccccacctcccggagaagaagatcacccagtggctggagaccaagggcgtcgagcgcctgaagcggatggccatctccggcgacgactgcgtggtgaagcccatcgacgaccgcttcgcgaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctcaaggagacggcctgcctgggcaaggcctacgcccagatgtggagcctgatgtacttccaccgccgcgacctccggctggcctccaacgcgatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggctccctgatcgggctgaccagccgggccacctgggcccagaacatcccgacggcgatccagcaggtccgcagcctcatcggcaacgaggagttcctggactacatgccctccatgaagcggttccgcaaggaggaggagagcgagggggccatctggtga

SEQ ID NO: 10220 - RNA, 9873 nt, synthetic construct
  misc_feature 1..9873: note = derived and/or modified CDS sequence (opt1) from DENV-3__FJ639746__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtggtggagcacctggagcgcctccagcggaagcacggcgggatgctggtccgcaaccccctgtcccggaacagcacccacgagatgtactggatctccaacggcaccgggaacatcgtggccagcgtgaacatggtctcccgcctcctgctgaaccggttcaccatgacgcaccgccggccgaccatcgagaaggacgtggacctcggcgcgggcacccgccacgtgaacgccgagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcctccagcatgatcaacggcgtcgtgaagctgctgaccaagccctgggacgtggtccccatggtgacgcagatggcgatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgggaggagttcaccaagaaggtgcgcaccaacgccgccatgggcgcggtcttcacggaggagaaccagtgggactccgccaaggccgccgtggaggacgaggacttctggaagctcgtggaccgcgagcgggagctgcacaagctggggaagtgcggcagctgcgtctacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctcatccgccagatggagggcgagggggtgctgagcaaggccgacctggagaacccccggctcccggagaagaagatcacccagtggctggagacgaagggcgtggagcgcctgaagcggatggcgatctccggcgacgactgcgtcgtgaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtccccgtgcactgggtgccgacctcccggaccacgtggagcatccacgcccaccaccagtggatgaccaccgaggacatgctgaccgtctggaaccgcgtgtggatcgaggacaacccctggatggaggacaagacgcccatcaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10221 - RNA, 9873 nt, synthetic construct
  misc_feature 1..9873: note = derived and/or modified CDS sequence (opt1) from DENV-3__FJ639750__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10222 - RNA, 9873 nt, synthetic construct
  misc_feature 1..9873: note = derived and/or modified CDS sequence (opt1) from DENV-3__FJ639754__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggcaactacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaactccacgtggcactacgacgacgagaacccgtacaagacctgggcctaccacggcagctacgaggtcaaggccaccgggtccgccagctccatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatctcccgcaaggaccagcggggcagcggccaggtgggcacgtacgggctgaacaccttcaccaacatggaggcccagctcatccgccagatggagggcgagggggtcctgtccaaggccgacctggagaacccccacctcccggagaagaagatcacccagtggctggagacgaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcaccacgtggtccatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgaccagccgggccacgtgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10223 - RNA, 9873 nt, synthetic construct
  misc_feature 1..9873: note = derived and/or modified CDS sequence (opt1) from DENV-3__FJ639757__SS-prME
  source 1..9873: mol_type = other RNA
accagcctgtgcctcatgatgatcctgcccgccgccctggcgttccacctcacctcccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggactccgccctgaagatcaactggtacaagaagggcagctccatcgggaagatgttcgaggcgaccgcccggggcgcccgccggatggccatcctgggcgacaccgcctgggacttcgggagcgtgggcggggtcctcaactccctgggcaagatggtgcaccagatcttcgggagcgcgtacacggccctgttctccggcgtgagctgggtcatgaagatcggcatcggggtgctcctgacctggatcggcctgaactccaagaacaccagcatgtccttcagctgcatcgccatcgggatcatcaccctctacctgggcgccgtggtccaggccgacatggggtgcgtgatcaactggaagggcaaggagctgaagtgcggctccgggatcttcgtgacgaacgaggtccacacctggaccgagcagtacaagttccaggcggacagccccaagcgcctcgccaccgccatcgccggcgcctgggagaacggggtgtgcggcatccgctccacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtacagctggaagacctgggggaaggccaagatcgtcaccgccgagacccagaactccagcttcatcatcgacggccccaacacgcccgagtgcccctccgccagccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagtcccagaagaacgggagctggaagctggagaaggcgtccctgatcgaggtgaagacctgcacgtggcccaagtcccacaccctctggtccaacggcgtgctggagagcgacatgatcatccccaagtccctggccgggcccatcagccagcacaactaccggccgggctaccacacccagaccgccgggccctggcacctcggcaagctggagctggacttcaactactgcgagggcacgaccgtcgtgatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccggggaggtggacaacttcacgatgggcgtcctgtgcctcgccatcctgttcgaggaggtgatgcgggggaagttcggcaagaagcacatgatcgcgggggtgttcttcaccttcgtcctgctcctgagcggccagatcacctggcgcgacatggcccacaccctgatcatgatcggctccaacgccagcgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatctccctcacgtgcagcaacaccatcttcaccctgaccgtcgcctggcgcacggccaccctgatcctcgcgggggtgtccctgctgccggtctgccagagctccagcatgcggaagaccgactggctccccatgaccgtggccgccatgggcgtgccgcccctcccgctgttcatcttctccctcaaggacacgctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggaccagcgccgacctgaccgtcgagaaggccgcggacgtgacgtgggaggaggaggccgagcagaccggcgtgtcccacaacctgatgatcaccgtcgacgacgacgggaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggctcccccatcatcaaccgcgagggcaaggtggtcgggctgtacggcaacggggtggtgacgaagaacggcgggtacgtcagcggcatcgcccagaccaacgccgagccggacggccccacccccgagctggaggaggagatgttcaagaagcggaacctcaccatcatggacctgcaccccgggtccggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagagcgagcacaccggccgggagatcgtggacctgatgtgccacgccaccttcacgatgcgcctcctgtcccccgtgcgggtcccgaactacaacctgatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctccggaagaacgggaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacggccccgagcgcgtcatcctggccgggcccatgccggtgaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggacttcgccgcgggccgcaagtccatcgccctggacctggtgaccgagatcgggcgggtccccacccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgtccaaggagccgggggtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgacgctggccaccggccccatcaccaccctctgggagggctcccccgggaagttctggaacacgaccatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggccgacctggagaacccccacctcccggagaagaagatcacgcagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10224 - RNA, 9873 nt, synthetic construct
  misc_feature 1..9873: note = derived and/or modified CDS sequence (opt1) from DENV-3__FJ639758__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacgtgatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacaccagcgagcacggcgggaaggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtggtcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcaccatgacgcaccgccggccgaccatcgagaaggacgtggacctcggcgcgggcacccgccacgtcaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtgaagctgctgaccaagccctgggacgtcgtgcccatggtgacgcagatggcgatgaccgacaccacccccttcgggcagcagcgggtcttcaaggagaaggtggacacgcgcaccccgcggagcatgcccggcacccgccgggtgatgggcatcaccgccgagtggctctggcgcacgctggggcggaacaagaagccccgcctgtgcacccgggaggagttcaccaagaaggtccgcaccaacgccgccatgggcgcggtgttcacggaggagaaccagtgggactccgccaaggccgccgtggaggacgaggacttctggaagctcgtcgaccgcgagcgggagctgcacaagctggggcgctgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaccggcaccgtcatggacatcatcagccggaaggaccagcgcggctccggccaggtgggcacgtacgggctgaacaccttcaccaacatggaggcccagctcatccggcagatggagggcgagggggtgctgagcaaggccgacctggagaacccccgcctcccggagaagaagatcacccagtggctggagacgaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccctccgcgagaccgcctgcctgggcaaggcctacgcccagatgtggagcctgatgtacttccaccggcgcgacctccggctggcgtccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10225 - RNA, 9873 nt, synthetic construct
  misc_feature 1..9873: note = derived and/or modified CDS sequence (opt1) from DENV-3__FJ639759__SS-prME
  source 1..9873: mol_type = other RNA
accagcctgtgcctcatgatgatcctgcccgccgccctggcgttccacctcacctcccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgctgttcaccttcgtcctcctgctgtccggccagatcacctggcgcgacatggcccacacgctcatcatgatcggcagcaacgcctccgaccggatggggatgggcgtgacctacctggccctgatcgccaccttcaagatccagcccttcctcgcgctggggttcttcctgcgcaagctcaccagccgggagaacctgctgctcggcgtgggcctggccatggccacgaccctgcagctccccgaggacatcgagcagatggccaacgggatcgcgctgggcctgatggccctcaagctgatcacccagttcgagacctaccagctgtggacggccctcatcagcctgacctgctccaacaccatcttcaccctgacggtcgcctggcgcaccgccaccctcatcctggcgggggtgagcctgctcccggtctgccagtccagctccatgcggaagaccgactggatccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaagatcgtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtccgggaggcgatcaagcgccggctccgcaccctgatcctggcccccacccgggtggtggccgccgagatggaggaggccctcaaggggctgcccatccgctaccagacgtccgcgaccaagagcgagcacaccggccgggagatcgtcgacctgatgtgccacgccaccttcacgatgcgcctcctgtcccccgtgcgggtgccgaactacaacctgatcatcatggacgaggcccacttcaccgaccccgccagcatcgccgcgcgcgggtacatctccacccgggtcggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtgccctccatcaaggcgggcaacgacatcgccaactgcctccggaagaacgggaagaaggtcatccagctgagccgcaagacgttcgacaccgagtaccagaagaccaagctgaacgactgggacttcgtggtgaccacggacatctccgagatgggcgccaacttcaaggccgaccgggtcatcgacccgcgccggtgcctcaagcccgtgatcctgaccgacggccccgagcgcgtgatcctggccgggcccatgccggtcaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtggagctgatgcgccgcggggacctccccgtctggctggcgcacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtacagcgacccgctggccctcaaggagttcaaggacttcgccgcgggccgcaagtccatcgccctggacctggtgaccgagatcgggcgggtgcccacccacctcgcccaccgcacccggaacgccctggacaacctggtcatgctccacacgagcgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccacgaagcgcgacctgggcatgtccaaggagccgggggtggtgagccccacctcctacctggacgtcgacctccaccccgccagcgcctggaccctgtacgccgtggcgaccacggtgatcacccccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgacgctgaccgccgccgtgctcctgctgatcacccactacgccatcatcggccccggcctccaggcgaaggccacccgcgaggcccagaagcggacggccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcacgatgacccaccgccggccgaccatcgagaaggacgtggacctcggcgcgggcacccgccacgtcaacgccgagcccgagacgcccaacatggacgtgatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggcgatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgggaggagttcaccaagaaggtccgcacgaacgccgccatgggcgcggtgttcaccgaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatcagccgcaaggaccagcggggctccggccaggtgggcacctacgggctgaacaccttcaccaacatggaggcccagctcatccgccagatggagggcgagggggtgctgagcaaggccgacctggagaacccccacctcccggagaagaagatcacgcagtggctggagaccaagggcgtcgagcggctgaagcgcatggcgatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtgcactgggtcccgacctcccgcacgacctggagcatccacgcccaccaccagtggatgaccaccgaggacatgctgacggtgtggaaccgggtgtggatcgaggacaacccctggatggaggacaagacccccgtcaccacctgggagaacgtgccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10226 - RNA, 9873 nt, synthetic construct
  misc_feature 1..9873: note = derived and/or modified CDS sequence (opt1) from DENV-3__FJ639761__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctgcagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgtcatgctgttcctgatcagcggcaaggggatcggcaagacgagcatcgggctgatctgcgtgatcgcctccagcggcatgctctggatggccgagatcccgctgcagtggatcgcctccgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccacgaagcgcgacctgggcatgagcaaggagccgggggtcgtgtcccccaccagctacctggacgtggacctccaccccgcgtccgcctggaccctgtacgccgtcgccaccacggtgatcacccccatgctgcggcacaccatcgagaacagcaccgcgaacgtgtccctcgccgccatcgccaaccaggccgtcgtgctgatgggcctggacaaggggtggccgatcagcaagatggacctcggcgtgcccctgctggcgctcgggtgctactcccaggtcaaccccctgacgctgaccgccgccgtgctcctgctgatcacccactacgccatcatcggccccggcctccaggccaaggcgacccgcgaggcccagaagcggacggccgccgggatcatgaagaacccgaccgtggacggcatcatgaccatcgacctggaccccgtcatctacgacagcaagttcgagaagcagctgggccaggtgatgctcctggtgctgtgcgccgtccagctcctgctgatgcgcacctcctgggcgctctgcgaggccctgacgctggccaccggccccatcaccaccctctgggagggcagccccgggaagttctggaacacgaccatcgccgtgtccatggcgaacatcttccggggcagctacctggccggggccggcctggccttctccatcatgaagtccgtggggaccggcaagcgcggcaccgggctccagggcgagaccctgggggagaagtggaagaagaagctgaaccagctctcccggaaggagttcgacctgtacaagaagtccggcatcacggaggtcgaccgcaccgaggccaaggaggggctgaagcggggcgagatcacccaccacgcggtgagccgcggctccgccaagctccagtggttcgtggagcggaacatggtcatcccggaggggcgcgtgatcgacctgggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctcatgagcgggaaggacgtcttctacctgccgcccgagaagtgcgacaccctgctgtgcgacatcggcgagtccagcccctcccccaccgtggaggagagccggacgatccgcgtgctcaagatggtcgagccgtggctgaagaacaaccagttctgcatcaaggtgctgaacccctacatgcccaccgtgatcgagcacctcgagcgcctgcagcggaagcacggcgggatgctggtccgcaaccccctctcccggaacagcacccacgagatgtactggatctccaacggcaccgggaacatcgtggccagcgtgaacatggtctcccgcctgctgctcaaccggttcacgatgacccaccgccggccgaccatcgagaaggacgtggacctgggcgccggcacccgccacgtgaacgcggagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctcacgaagccctgggacgtggtccccatggtgacccagatggccatgaccgacaccacgcccttcgggcagcagcgggtgttcaaggagaaggtcgacacccgcaccccgcggtccatgcccggcacccgccgggtgatgggcatcacggcggagtggctgtggcgcaccctggggcggaacaagaagccccgcctctgcacccgggaggagttcaccaagaaggtgcgcacgaacgccgccatgggcgccgtcttcaccgaggagaaccagtgggacagcgcgaaggccgccgtggaggacgaggacttctggaagctggtggaccgcgagcgggagctgcacaagctcgggaagtgcggcagctgcgtctacaacatgatggggaagcgcgagaagaagctgggcgagttcggcaaggccaaggggtcccgggccatctggtacatgtggctgggcgcgcgctacctcgagttcgaggccctggggttcctgaacgaggaccactggttcagccgggagaactcctacagcggcgtggagggggagggcctccacaagctgggctacatcctgcgcgacatctccaagatccccgggggcgccatgtacgccgacgacaccgccgggtgggacacccggatcacggaggacgacctccacaacgaggagaagatcacccagcagatggacccggagcaccgccagctggcgaacgccatcttcaagctgacctaccagaacaaggtggtcaaggtgcagcggcccacccccaccggcacggtgatggacatcatcagccgcaaggaccagcggggctccgggcaggtcggcacctacgggctcaacaccttcaccaacatggaggcccagctgatccgccagatggagggcgagggggtgctgagcaaggccgacctcgagaacccccacctccccgagaagaagatcacgcagtggctggagaccaagggcgtggagcggctgaagcgcatggccatctccggcgacgactgcgtcgtgaagcccatcgacgaccggttcgcgaacgccctgctggccctcaacgacatggggaaggtgcgcaaggacatcccccagtggcagcccagcaagggctggcacgactggcagcaggtcccgttctgctcccaccacttccacgagctgatcatgaaggacgggcggaagctggtggtgccctgccgcccccaggacgagctcatcggccgggcccgcatcagccagggggccggctggtccctgcgggagaccgcgtgcctgggcaaggcctacgcccagatgtggagcctcatgtacttccaccgccgcgacctgcggctggcctccaacgcgatctgcagcgccgtccccgtgcactgggtgccgacctcccgcacgacctggagcatccacgcccaccaccagtggatgaccaccgaggacatgctcacggtctggaaccgggtgtggatcgaggacaacccctggatggaggacaagacccccgtgaccacctgggagaacgtcccctacctggggaagcgcgaggaccagtggtgcggctccctgatcgggctcacgagccgggccacctgggcccagaacatcccgaccgcgatccagcaggtccgcagcctgatcggcaacgaggagttcctggactacatgccctccatgaagcggttccgcaaggaggaggagagcgagggggccatctggtga

SEQ ID NO: 10227 - RNA, 9873 nt, synthetic construct
  misc_feature 1..9873: note = derived and/or modified CDS sequence (opt1) from DENV-3__FJ639762__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaagatcgagtacaagggcgaggacgtgccgtgcaagatccccttcagcaccgaggacgggcagggcaaggcgcacaacggccgcctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggccgacatggggtgcgtcatcaactggaagggcaaggagctgaagtgcggcagcgggatcttcgtgacgaacgaggtgcacacctggaccgagcagtacaagttccaggcggactcccccaagcgcctcgccaccgccatcgccggcgcctgggagaacggggtctgcggcatccgcagcacgacccggatggagaacctgctgtggaagcagatcgcgaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgccgacatgggctactggatcgagagccagaagaacgggtcctggaagctggagaaggcgagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcggggaggtggacaacttcacgatgggcgtgctgtgcctcgccatcctgttcgaggaggtcatgcgggggaagttcggcaagaagcacatgatcgcggggatcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaagatcgtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagctccatgatcaacggcgtggtgaagctgctgacgaagccctgggacgtcgtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatctcccgcaaggaccagcggggcagcggccaggtgggcacctacgggctgaacaccttcaccaacatggaggcccagctcatccgccagatggagggcgagggggtcctgtccaaggccgacctggagaacccccacctcccggagaagaagatcacgcagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcacgacctggtccatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10228 - RNA, 9873 nt, synthetic construct
  misc_feature 1..9873: note = derived and/or modified CDS sequence (opt1) from DENV-3__FJ639763__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggccgtgatcttcatcctgctgatgctcgtgacgcccagcatgaccatgcggtgcgtgggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggcgacccagctggccacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcggggaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatgaccgtcgccgccatgggcgtgccgcccctcccgctgttcatcttcagcctcaaggacacgctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacgtcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgcggccggccgcaagagcatcgccctggacctggtgaccgagatcgggcgggtgccctcccacctcgcccaccgcacccggaacgccctggacaacctggtcatgctccacaccagcgagcacggcgggaaggcgtaccgccacgccgtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgcgagcgccatcgtcctggagttcttcatgatggtgctcctgatccccgagcccgagaagcagcggacgccccaggacaaccagctggcctacgtggtcatcgggatcctcaccctggccgccatcatcgcggccaacgagatgggcctgctcgagaccaccaagcgcgacctgggcatgtccaaggagccgggggtggtgagccccacgtcctacctggacgtcgacctccaccccgccagcgcctggaccctgtacgcggtggccaccaccgtgatcacgcccatgctgcggcacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgaccctgacggccgccgtgctcctgctgatcacccactacgcgatcatcggccccggcctccaggccaaggccacccgcgaggcccagaagcggaccgccgcggggatcatgaagaacccgacggtcgacggcatcatgaccatcgacctggaccccgtgatctacgactccaagttcgagaagcagctgggccaggtgatgctcctggtcctgtgcgccgtgcagctcctgctgatgcgcaccagctgggccctctgcgaggccctgaccctggcgacgggccccatcaccaccctctgggagggctcccccgggaagttctggaacaccacgatcgccgtgagcatggccaacatcttccggggctcctacctggccggggccggcctggcgttcagcatcatgaagtccgtcgggaccggcaagcgcggcaccgggagccagggcgagaccctcggggagaagtggaagaagaagctgaaccagctgagccggaaggagttcgacctctacaagaagtccggcatcaccgaggtggaccgcacggaggccaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccggaccatccgcgtcctgaagatggtggagccgtggctcaagaacaaccagttctgcatcaaggtgctgaacccctacatgcccacggtcatcgagcacctggagcgcctccagcggaagcacggcgggatgctggtgcgcaaccccctgtcccggaacagcacccacgagatgtactggatctccaacggcaccgggaacatcgtggcgagcgtcaacatggtgtcccgcctcctgctgaaccggttcaccatgacgcaccgccggccgaccatcgagaaggacgtggacctcggcgccggcacccgccacgtcaacgccgagcccgagacccccaacatggacgtgatcggggagcggatcaagcgcatcaaggaggagcacaacagcacgtggcactacgacgacgagaacccgtacaagacctgggcctaccacggctcctacgaggtgaaggccaccgggagcgcgtccagcatgatcaacggcgtcgtgaagctgctgaccaagccctgggacgtcgtgcccatggtgacgcagatggccatgaccgacaccacccccttcgggcagcagcgggtcttcaaggagaaggtggacacgcgcaccccgcggagcatgcccggcacccgccgggtgatgggcatcaccgccgagtggctctggcgcacgctggggcggaacaagaagccccgcctgtgcacccgggaggagttcaccaagaaggtccgcaccaacgccgcgatgggcgccgtgttcacggaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggcggacctggagaacccccacctcccggagaagaagatcacccagtggctggagacgaacggcgtcgagcggctgaagcgcatggccatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcgcgcatcagccagggggccggctggtccctccgggagaccgcctgcctgggcaaggcctacgcgcagatgtggagcctgatgtacttccaccgccgcgacctccggctggcctccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggcgacgtgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10229 - RNA, 9873 nt, synthetic construct
  misc_feature 1..9873: note = derived and/or modified CDS sequence (opt1) from DENV-3__FJ639765__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcatcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccacgaagcgcgacctgggcatgagcaaggagccgggggtggtgtcccccaccagctacctggacgtcgacctccaccccgcctccgcctggaccctgtacgccgtggcgaccacggtgatcacccccatgctgcggcacaccatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgacgctgaccgccgccgtgctcctgctgatcacccactacgccatcatcggccccggcctccaggcgaaggccacccgcgaggcccagaagcggacggccgccgggatcatgaagaacccgaccgtcgacggcatcatgaccatcgacctggaccccgtgatctacgacagcaagttcgagaagcagctgggccaggtgatgctcctggtcctgtgcgcggtgcagctcctgctgatgcgcacctcctgggccctctgcgaggccctgacgctggccaccggccccatcaccaccctctgggagggcagccccgggaagttctggaacacgaccatcgcggtgtccatggccaacatcttccggggcagctacctggccggggccggcctggccttctccatcatgaagtccgtcgggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcaccgaggtgcgcggctacacgaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcaccgggaacatcgtggcctccgtcaacatggtgagccgcctcctgctgaaccggttcacgatgacccaccgccggccgaccatcgagaaggacgtggacctcggcgcgggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggccaccgggtccgccagctccatgatcaacggcgtcgtgaagctgctgacgaagccctgggacgtcgtgcccatggtgacccagatggcgatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgggaggagttcaccaagaaggtccgcacgaacgccgccatgggcgcggtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatctcccgcaaggaccagcggggcagcggccaggtgggcacctacgggctgaacaccttcaccaacatggaggcccagctcatccgccagatggagggcgagggggtgctgtccaaggccgacctggagaacccccacctcccggagaagaagatcacgcagtggctggagaccaagggcgtcgagcggctgaagcgcatggcgatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcgggaagcgcgaggaccagtggtgcggcagcctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10230 - RNA, 9873 nt, synthetic construct
  misc_feature 1..9873: note = derived and/or modified CDS sequence (opt1) from DENV-3__FJ639766__SS-prME
  source 1..9873: mol_type = other RNA
accagcctgtgcctcatgatgatcctgcccgccgccctggcgttccacctcacctcccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcaacctcaaggacacgctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggaccagcgccgacctgaccgtcgagaaggccgcggacgtgacgtgggaggaggaggccgagcagaccggcgtgtcccacaacctgatgatcaccgtcgacgacgacgggaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctggaggaggagatgttcaagaagcggaacctcaccatcatggacctgcaccccgggtccggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagagcgagcacaccggccgggagatcgtggacctgatgtgccacgccaccttcacgatgcgcctcctgtcccccgtgcgggtcccgaactacaacctgatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctccggaagaacgggaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacggccccgagcgcgtcatcctggccgggcccatgccggtgaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggacttcgccgcgggccgcaagtccatcgccctggacctggtgaccgagatcgggcgggtccccacccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatctccggcaaggggatcggcaagacgagcatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgtccaaggagccgggggtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgacgctggccaccggccccatcaccaccctctgggagggctcccccgggaagttctggaacacgaccatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgtcccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggtccatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggccgacctggagaacccccacctcccggagaagaagatcacgcagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggctccctgatcgggctgacgagccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10231 - RNA, 9873 nt, synthetic construct
  misc_feature 1..9873: note = derived and/or modified CDS sequence (opt1) from DENV-3__FJ639767__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccatctcctacctggacgtggacctccaccccgccagcgcctggacgctgtacgccgtggcgaccaccgtcatcacccccatgctgcggcacacgatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgaccgccgccgtcctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtgatctacgactccaagttcgagaagcagctggggcaggtcatgctcctggtgctgtgcgcggtgcagctcctgctgatgcgcaccagctgggccctctgcgaggccctgaccctggccaccggccccatcacgaccctctgggagggctcccccgggaagttctggaacaccaccatcgcggtcagcatggccaacatcttccggggctcctacctggccggggccggcctggccttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtggaccgcaccgaggcgaaggaggggctgaagcggggcgagatcacgcaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacgcacgagatgtactggatctccaacggcaccgggaacatcgtcgccagcgtgaacatggtgtcccgcctcctgctgaaccggttcaccatgacccaccgccggccgacgatcgagaaggacgtcgacctcggcgcgggcacccgccacgtgaacgccgagcccgagacccccaacatggacgtgatcggggagcggatcaagcgcatcaaggaggagcacaacagcacctggcactacgacgacgagaacccgtacaagacgtgggcctaccacggctcctacgaggtcaaggccaccgggagcgcctccagcatgatcaacggcgtggtcaagctgctgaccaagccctgggacgtggtgcccatggtcacccagatggcgatgacggacaccacccccttcgggcagcagcgggtgttcaaggagaaggtggacacccgcacgccgcggagcatgcccggcacccgccgggtcatgggcatcaccgccgagtggctctggcgcaccctggggcggaacaagaagccccgcctgtgcacgcgggaggagttcaccaagaaggtgcgcaccaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacgtaccagaacaaggtggtgaaggtccagcggcccacccccaccggcaccgtgatggacatcatcagccgcaaggaccagcggggctccggccaggtgggcacctacgggctgaacacgttcaccaacatggaggcccagctcatccgccagatggagggcgagggggtcctgagcaaggccgacctggagaacccccacctcccggagaagaagatcacccagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagacggcctgcctgggcaaggcctacgcccagatgtggagcctgatgtacttccaccgccgcgacctccggctggcgtccaacgccatctgcagcgccgtgcccgtccactgggtgccgacctcccgcaccacctggagcatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggcagcctgatcgggctgacctcccgggccacctgggcgcagaacatcccgacggccatccagcaggtccgcagcctcatcggcaacgaggagttcctggactacatgccctccatgaagcggttccgcaaggaggaggagagcgagggggccatctggtga

SEQ ID NO: 10232 - RNA, 9873 nt, synthetic construct
  misc_feature 1..9873: note = derived and/or modified CDS sequence (opt1) from DENV-3__FJ639768__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagacggccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctcaacgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctggaggaggagatgttcaagaagcggaacctcaccatcatggacctgcaccccgggtccggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagagcgagcacaccggccgggagatcgtggacctgatgtgccacgccaccttcacgatgcgcctcctgtcccccgtgcgggtcccgaactacaacctgatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctccggaagaacgggaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacggccccgagcgcgtcatcctggccgggcccatcccggtgaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggacttcgccgcgggccgcaagtccatcgccctggacctggtgaccgagatcgggcgggtccccagccacctcgcccaccgcacccggaacgccctggacaacctggtgatgctccacacctccgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagaccagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgagcaaggagccgggggtggtctcccccacgagctacctggacgtggacctccaccccgcctccgcctggaccctgtacgccgtggcgaccaccgtcatcacgcccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgaccctggccacgggccccatcaccaccctctgggagggcagccccgggaagttctggaacaccacgatcgcggtctccatggccaacatcttccggggcagctacatcgccggggccggcctggccttctccatcatgaagtccgtggggaccggcaagcgcggcaccgggtcccagggcgagaccctgggggagaagtggaagaagaagctcaaccagctgagccggaaggagttcgacctgtacaagaagtccggcatcaccgaggtggaccgcacggaggcgaaggaggggctcaagcggggcgagatcacccaccacgccgtctcccgcggcagcgccaagctgcagtggttcgtggagcggaacatggtgatcccggaggggcgcgtcatcgacctgggctgcgggcggggcgggtggtcctactactgcgccggcctcaagaaggtgaccgaggtgcgcggctacaccaagggcgggcccgggcacgaggagcccgtccccatgagcacgtacggctggaacatcgtgaagctgatgtccgggaaggacgtgttctacctgccgcccgagaagtgcgacaccctcctgtgcgacatcggcgagagctcccccagccccaccgtcgaggagtcccggaccatccgcgtgctgaagatggtggagccgtggctgaagaacaaccagttctgcatcaaggtcctcaacccctacatgcccacggtgatcgagcacctggagcgcctgcagcggaagcacggcgggatgctcgtgcgcaaccccctgagccggaactccacccacgagatgtactggatcagcaacggcaccgggaacatcgtcgcctccgtgaacatggtgagccgcctgctcctgaaccggttcaccatgacgcaccgccggccgaccatcgagaaggacgtcgacctgggcgcgggcacccgccacgtgaacgccgagcccgagacccccaacatggacgtgatcggggagcggatcaagcgcatcaaggaggagcacaactccacgtggcactacgacgacgagaacccgtacaagacctgggcctaccacggcagctacgaggtcaaggccaccgggtccgccagctccatgatcaacggcgtggtcaagctcctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctgtggcgcacgctcgggcggaacaagaagccccgcctgtgcacccgggaggagttcaccaagaaggtgcgcaccaacgccgccatgggcgcggtgttcacggaggagaaccagtgggacagcgccaaggccgccgtcgaggacgaggacttctggaagctggtggaccgcgagcgggagctccacaagctggggaagtgcggctcctgcgtgtacaacatgatggggaagcgcgagaagaagctgggcgagttcggcaaggccaaggggagccgggcgatctggtacatgtggctcggcgcccgctacctggagttcgaggccctggggttcctcaacgaggaccactggttctcccgggagaacagctactccggcgtcgagggggagggcctgcacaagctgggctacatcctccgcgacatcagcaagatccccgggggcgccatgtacgccgacgacaccgcggggtgggacacccggatcaccgaggacgacctgcacaacgaggagaagatcacgcagcagatggacccggagcaccgccagctggccaacgccatcttcaagctcacctaccagaacaaggtggtgaaggtccagcggcccacccccaccggcaccgtgatggacatcatctcccgcaaggaccagcggggcagcggccaggtgggcacgtacgggctgaacaccttcaccaacatggaggcccagctgatccgccagatggagggcgagggggtcctctccaaggccgacctggagaacccccacctccccgagaagaagatcacccagtggctggagacgaagggcgtggagcggctgaagcgcatggcgatcagcggcgacgactgcgtggtcaagcccatcgacgaccggttcgccaacgccctgctcgccctgaacgacatggggaaggtgcgcaaggacatcccccagtggcagccctccaagggctggcacgactggcagcaggtcccgttctgcagccaccacttccacgagctgatcatgaaggacgggcggaagctcgtcgtgccctgccgcccccaggacgagctgatcggccgggcccgcatctcccagggggcgggctggagcctgcgggagaccgcctgcctcggcaaggcctacgcccagatgtggtccctgatgtacttccaccgccgcgacctgcggctcgcgagcaacgccatctgctccgccgtgcccgtccactgggtgccgaccagccgcaccacgtggtccatccacgcccaccaccagtggatgaccaccgaggacatgctgaccgtgtggaaccgggtctggatcgaggacaacccctggatggaggacaagacgcccgtgaccacctgggagaacgtgccctacctggggaagcgcgaggaccagtggtgcggcagcctcatcgggctgaccagccgggccacgtgggcgcagaacatcccgaccgccatccagcaggtccgctccctgatcggcaacgaggagttcctcgactacatgcccagcatgaagcggttccgcaaggaggaggagtccgagggggccatctggtga

SEQ ID NO: 10233 - RNA, 9873 nt, synthetic construct
  misc_feature 1..9873: note = derived and/or modified CDS sequence (opt1) from DENV-3__FJ639769__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgtggtccagctcctgctgatgcgcacctcctgggcgctctgcgaggccctgacgctggccaccggccccatcaccaccctctgggagggcagccccgggaagttctggaacacgaccatcgccgtgtccatggcgaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtcgaccgcaccgaggccaaggaggggctgaagcggggcgagatcacccaccacgcggtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccggacgatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcaccgggaacatcgtggcctccgtgaacatggtcagccgcctcctgctgaaccggttcacgatgacccaccgccggccgaccatcgagaaggacgtggacctcggcgccggcacccgccacgtgaacgcggagcccgagacgcccaacatggacgtcatcggggagcggatcaagcgcatcaaggaggagcacaactccacctggcactacgacgacgagaacccgtacaagacctgggcctaccacggcagctacgaggtgaaggccaccgggtccgccagctccatgatcaacggcgtcgtgaagctgctgacgaagccctgggacgtggtccccatggtgacccagatggccatgaccgacaccacgcccttcgggcagcagcgggtgttcaaggagaaggtcgacacccgcaccccgcggagcatgcccggcacccgccgggtgatgggcatcacggcggagtggctctggcgcaccctggggcggaacaagaagccccgcctgtgcacccgggaggagttcaccaagaaggtgcgcacgaacgccgccatgggcgccgtcttcaccgaggagaaccagtgggacagcgcgaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgccgggtgggacacccggatcacggaggacgacctgcacaacgaggagaagatcacccagcagatggacccggagcaccgccagctcgcgaacgccatcttcaagctgacctaccagaacaaggtggtcaaggtgcagcggcccacccccaccggcacggtgatggacatcatctcccgcaaggaccagcggggcagcgggcaggtcggcacctacgggctgaacaccttcaccaacatggaggcccagctcatccgccagatggagggcgagggggtgctgtccaaggccgacctggagaacccccacctcccggagaagaagatcacgcagtggctggagaccaagggcgtggagcggctgaagcgcatggccatcagcggcgacgactgcgtcgtgaagcccatcgacgaccggttcgcgaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcccgcatctcccagggggccggctggagcctccgggagaccgcgtgcctgggcaaggcctacgcccagatgtggtccctgatgtacttccaccgccgcgacctccggctggccagcaacgcgatctgctccgccgtccccgtgcactgggtgccgaccagccgcacgacctggtccatccacgcccaccaccagtggatgaccaccgaggacatgctgacggtctggaaccgggtgtggatcgaggacaacccctggatggaggacaagacccccgtgaccacctgggagaacgtcccctacctcgggaagcgcgaggaccagtggtgcggcagcctgatcgggctgacgagccgggccacctgggcccagaacatcccgaccgcgatccagcaggtccgctccctcatcggcaacgaggagttcctggactacatgcccagcatgaagcggttccgcaaggaggaggagtccgagggggccatctggtga

SEQ ID NO: 10234 - RNA, 9873 nt, synthetic construct
  misc_feature 1..9873: note = derived and/or modified CDS sequence (opt1) from DENV-3__FJ882577__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcggggatcttcttcaccttcgtgctgctcctgtccggccagatcacctggcgcgacatggcccacaccctgatcatgatcggcagcaacgcctccgaccggatggggatgggcgtcacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtcgccgccatgggcgtgccgcccctcccgctgttcatcttcagcctcaaggacacgctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcaccgggacctccgccgacctgaccgtggagaaggccgcggacgtcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacaccatgtggcacgtgacgcggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagacgaccaccggggagatcggcgcgatcgccctggacttcaagcccgggaccagcggcagccccatcatcaaccgcgagggcaagatcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgcccacccacctcgcccaccgcacccggaacgccctggacaacctggtgatgctccacacgtccgagcacggcgggaaggcctaccgccacgcggtcgaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccacgaagcgcgacctgggcatgagcaaggagccgggggtcgtgtcccccaccagctacctggacgtggacctccaccccgcctccgcctggaccctgtacgccgtcgcgaccacggtgatcacccccatgctgcggcacaccatcgagaacagcaccgccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgacgctgaccgccgccgtgctcctgctgatcacccactacgccatcatcggccccggcctccaggcgaaggccacccgcgaggcccagaagcggacggccgccgggatcatgaagaacccgaccgtggacggcatcatgaccatcgacctggaccccgtcatctacgacagcaagttcgagaagcagctgggccaggtgatgctcctggtgctgtgcgcggtccagctcctgctgatgcgcacctcctgggccctctgcgaggccctgacgctggccaccggccccatcaccaccctctgggagggcagccccgggaagttctggaacacgaccatcgcggtgtccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtcgaccgcaccgaggcgaaggaggggctgaagcggggcgagatcacccaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccggacgatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgagccggaactccacccacgagatgtactggatcagcaacggcaccgggaacatcgtggcctccgtgaacatggtcagccgcctcctgctgaaccggttcacgatgacccaccgccggccgaccatcgagaaggacgtggacctcggcgcgggcacccgccacgtgaacgccgagcccgagacgcccaacatggacgtcatcggggagcggatcaagcgcatcaaggaggagcacaactccacctggcactacgacgacgagaacccgtacaagacctgggcctaccacggcagctacgaggtgaaggccaccgggtccgccagctccatgatcaacggcgtggtcaagctgctgacgaagccctgggacgtggtccccatggtgacccagatggcgatgaccgacaccacgcccttcgggcagcagcgggtgttcaaggagaaggtcgacacccgcaccccgcggagcatgcccggcacccgccgggtgatgggcatcacggccgagtggctctggcgcaccctggggcggaacaagaagccccgcctgtgcacccgggaggagttcaccaagaaggtgcgcacgaacgccgccatgggcgcggtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtcaaggtgcagcggcccacccccaccggcacggtgatggacatcatctcccgcaaggaccagcggggcagcgggcaggtcggcacctacgggctgaacaccttcaccaacatggaggcccagctcatccgccagatggagggcgagggggtgctgtccaaggccgacctggagaacccccacctcccggagaagaagatcacgcagtggctggagaccaagggcgtggagcggctgaagcgcatggcgatcagcggcgacgactgcgtcgtgaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtccccgtgcactgggtgccgaccagccgcacgacctggtccatccacgcccaccaccagtggatgaccaccgaggacatgctgacggtctggaaccgggtgtggatcgaggacaacccctggatggaggacaagacccccgtgaccacctgggagaacgtcccctacctcgggaagcgcgaggaccagtggtgcggcagcctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10235 - RNA, 9873 nt, synthetic construct
  misc_feature 1..9873: note = derived and/or modified CDS sequence (opt1) from DENV-3__FJ850096__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtgacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcgggctcctgctgacctggatcggcctcaacagcaagaacacctccatgagcttctcctgcatcgccatcgggatcatcaccctgtacctgggcgccgtggtgcaggccgacatggggtgcgtcatcaactggaagggcaaggagctcaagtgcggcagcgggatcttcgtgacgaacgaggtgcacacctggaccgagcagtacaagttccaggcggactcccccaagcgcctggccaccgccatcgccggcgcctgggagaacggggtctgcggcatccgcagcacgacccggatggagaacctgctctggaagcagatcgcgaacgagctgaactacatcctgtgggagaacaacatcaagctcaccgtggtggtcggggacatcatcggcgtgctggagcagggcaagcgcaccctgacgccccagccgatggagctcaagtactcctggaagacctgggggaaggccaagatcgtgaccgccgagacccagaacagctccttcatcatcgacggccccaacacgcccgagtgccccagcgcctcccgggcgtggaacgtctgggaggtggaggactacgggttcggcgtgttcaccaccaacatctggctgaagctgcgcgaggtctacacccagctctgcgaccaccggctgatgagcgccgccgtgaaggacgagcgcgccgtgcacgccgacatgggctactggatcgagagccagaagaacgggtcctggaagctggagaaggcgagcctcatcgaggtcaagacctgcacgtggccgaagtcccacaccctgtggagcaacggcgtgctggagtccgacatgatcatccccaagagcctcgccgggcccatctcccagcacaactaccggccgggctaccacacccagaccgccgggccctggcacctgggcaagctggagctcgacttcaactactgcgagggcacgaccgtggtcatcaccgagaactgcgggacccgcggccccagcctgcggacgaccaccgtgtccgggaagctgatccacgagtggtgctgccgcagctgcaccctgccgcccctgcggtacatgggcgaggacgggtgctggtacggcatggagatccgccccatctccgagaaggaggagaacatggtcaagagcctggtctccgccggcagcggggaggtggacaacttcacgatgggcgtgctctgcctggccatcctgttcgaggaggtcatgcgggggaagttcggcaagaagcacatgatcgcgggggtgttcttcaccttcgtgctcctgctgtccggccagatcacctggcgcgacatggcccacaccctcatcatgatcggcagcaacgcctccgaccggatggggatgggcgtcacgtacctggccctgatcgccaccttcaagatccagcccttcctcgcgctggggttcttcctgcgcaagctcaccagccgggagaacctgctgctcggcgtgggcctggccatggccaccacgctgcagctccccgaggacatcgagcagatggccaacgggatcgcgctgggcctgatggccctcaagctgatcacccagttcgagacctaccagctgtggaccgccctcatcagcctgacgtgctccaacaccatcttcaccctgaccgtggcctggcgcacggccaccctcatcctggcgggggtcagcctgctccccgtgtgccagtccagctccatgcggaagaccgactggctgcccatgaccgtcgccgccatgggcgtgccgcccctccccctgttcatcttcagcctgaaggacacgctgaagcgccgctcctggcccctcaacgagggggtgatggccgtcggcctggtgagcatcctggcctccagcctcctgcggaacgacgtgcccatggcgggccccctggtcgccgggggcctcctgatcgcctgctacgtgatcaccgggacctccgccgacctgaccgtggagaaggccgcggacgtcacgtgggaggaggaggccgagcagaccggcgtgagccacaacctcatgatcaccgtggacgacgacgggaccatgcgcatcaaggacgacgagaccgagaacatcctgacggtcctgctcaagaccgccctgctgatcgtgtccggcatcttcccgtacagcatccccgccaccctcctggtgtggcacacctggcagaagcagacgcagcggtccggcgtcctgtgggacgtgccctccccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgcggtgctgacctacaacgggaagcgcctggagcccaactgggcctccgtcaagaaggacctcatcagctacggcgggggctggcggctgtccgcccagtggcagaagggggaggaggtccaggtgatcgccgtcgagcccggcaagaaccccaagaacttccagaccatgccgggcaccttccagacgaccaccggggagatcggcgcgatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctcgaggaggagatgttcaagaagcggaacctgaccatcatggacctgcaccccgggagcggcaagacgcgcaagtacctcccggccatcgtccgggaggcgatcaagcgccggctgcgcaccctgatcctcgcccccacccgggtggtggccgccgagatggaggaggccctgaaggggctgcccatccgctaccagaccacggcgaccaagtccgagcacaccggccgggagatcgtcgacctcatgtgccacgccaccttcacgatgcgcctgctgagccccgtgcgggtgccgaactacaacctcatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcaccgggaagacggtgtggttcgtgcccagcatcaaggccggcaacgacatcgcgaactgcctgcggaagaacgggaagaaggtcatccagctgtcccgcaagaccttcgacaccgagtaccagaagaccaagctcaacgactgggacttcgtggtgacgaccgacatcagcgagatgggcgccaacttcaaggccgaccgggtcatcgacccgcgccggtgcctgaagcccgtgatcctgaccgacggccccgagcgcgtgatcctcgccgggcccatgccggtcaccgccgcgtccgccgcccagcggcgcggccgggtggggcgcaacccccagaaggagaacgaccagtacatcttcaccggccagcccctgaacaacgacgaggaccacgcccactggacggaggccaagatgctgctcgacaacatcaacacccccgaggggatcatcccggcgctgttcgagcccgagcgggagaagtccgccgccatcgacggcgagtaccgcctgaagggcgagtcccggaagaccttcgtggagctcatgcgccgcggggacctgcccgtctggctggcccacaaggtggcgagcgagggcatcaagtacaccgaccgcaagtggtgcttcgacgggcagcggaacaaccagatcctcgaggagaacatggacgtcgagatctggacgaaggagggcgagaagaagaagctgcgcccccggtggctggacgcccgcacctactccgacccgctcgccctgaaggagttcaaggacttcgccgccggccgcaagagcatcgcgctggacctcgtgaccgagatcgggcgggtgccctcccacctggcccaccgcacccggaacgccctggacaacctcgtcatgctgcacacgagcgagcacggcgggaaggcctaccgccacgccgtggaggagctgcccgagaccatggagaccctcctgctgctcggcctgatgatcctgctcaccgggggcgcgatgctgttcctgatcagcggcaaggggatcggcaagacgtccatcgggctcatctgcgtgatcgccagctccggcatgctgtggatggccgagatcccgctgcagtggatcgccagcgccatcgtcctcgagttcttcatgatggtgctgctgatccccgagcccgagaagcagcggacgccccaggacaaccagctcgcgtacgtggtcatcgggatcctgaccctggccgccatcatcgccgccaacgagatgggcctcctggagaccacgaagcgcgacctgggcatgtccaaggagccgggggtggtgagccccacctcctacctcgacgtcgacctgcaccccgcgagcgcctggaccctgtacgccgtggccaccacggtgatcacccccatgctccggcacaccatcgagaactccaccgcgaacgtcagcctggccgccatcgccaaccaggccgtggtgctgatgggcctcgacaaggggtggccgatctccaagatggacctgggcgtccccctgctcgcgctggggtgctacagccaggtgaaccccctgacgctcaccgccgccgtgctgctgctcatcacccactacgccatcatcggccccggcctgcaggccaaggcgacccgcgaggcccagaagcggacggccgccgggatcatgaagaacccgaccgtcgacggcatcatgaccatcgacctggaccccgtgatctacgactccaagttcgagaagcagctcggccaggtgatgctgctggtcctctgcgccgtgcagctgctgctcatgcgcaccagctgggcgctgtgcgaggccctgacgctcgccaccggccccatcaccaccctgtgggagggctcccccgggaagttctggaacacgaccatcgccgtgagcatggcgaacatcttccggggctcctacctggccggggccggcctcgccttcagcatcatgaagtccgtcgggaccggcaagcgcggcaccgggagccagggcgagaccctgggggagaagtggaagaagaagctgaaccagctcagccggaaggagttcgacctgtacaagaagtccggcatcacggaggtggaccgcaccgaggccaaggaggggctgaagcggggcgagatcacccaccacgcggtgagccgcggctccgccaagctccagtggttcgtcgagcggaacatggtgatcccggaggggcgcgtgatcgacctgggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctcatgagcgggaaggacgtgttctacctgccgcccgagaagtgcgacaccctgctgtgcgacatcggcgagtccagcccctcccccaccgtggaggagagccggacgatccgcgtcctcaagatggtggagccgtggctgaagaacaaccagttctgcatcaaggtgctgaacccctacatgcccaccgtcatcgagcacctcgagcgcctgcagcggaagcacggcgggatgctggtgcgcaaccccctctcccggaacagcacccacgagatgtactggatctccaacggcaccgggaacatcgtggccagcgtcaacatggtgtcccgcctgctgctcaaccggttcacgatgacccaccgccggccgaccatcgagaaggacgtggacctgggcgccggcacccgccacgtcaacgcggagcccgagacgcccaacatggacgtgatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctcacgaagccctgggacgtcgtgcccatggtgacccagatggccatgaccgacaccacgcccttcgggcagcagcgggtcttcaaggagaaggtggacacccgcaccccgcggagcatgcccggcacccgccgggtgatgggcatcacggcggagtggctgtggcgcaccctggggcggaacaagaagccccgcctctgcacccgggaggagttcaccaagaaggtccgcacgaacgccgccatgggcgccgtgttcaccgaggagaaccagtgggactccgcgaaggccgccgtggaggacgaggacttctggaagctggtcgaccgcgagcgggagctgcacaagctcgggaagtgcggcagctgcgtgtacaacatgatggggaagcgcgagaagaagctgggcgagttcggcaaggccaaggggtcccgggccatctggtacatgtggctgggcgcgcgctacctcgagttcgaggccctggggttcctgaacgaggaccactggttcagccgggagaactcctacagcggcgtggagggggagggcctccacaagctgggctacatcctgcgcgacatctccaagatccccgggggcgccatgtacgccgacgacaccgccgggtgggacacccggatcacggaggacgacctccacaacgaggagaagatcacccagcagatggacccggagcaccgccagctggcgaacgccatcttcaagctgacctaccagaacaaggtcgtgaaggtgcagcggcccacccccaccggcacggtcatggacatcatcagccgcaaggaccagcggggctccggccaggtgggcacctacgggctcaacaccttcaccaacatggaggcccagctgatccgccagatggagggcgagggggtgctgagcaaggccgacctcgagaacccccacctcccggagaagaagatcacgcagtggctggagaccaagggcgtcgagcggctcaagcgcatggccatctccggcgacgactgcgtggtgaagcccatcgacgaccggttcgcgaacgccctgctggccctcaacgacatggggaaggtccgcaaggacatcccccagtggcagcccagcaagggctggcacgactggcagcaggtcccgttctgctcccaccacttccacgagctgatcatgaaggacgggcggaagctggtggtcccctgccgcccccaggacgagctcatcggccgggcccgcatcagccagggggccggctggtccctgcgggagaccgcgtgcctgggcaaggcctacgcccagatgtggagcctcatgtacttccaccgccgcgacctgcggctggcctccaacgcgatctgcagcgccgtgcccgtgcactgggtcccgacctcccgcacgacctggagcatccacgcccaccaccagtggatgaccaccgaggacatgctcacggtgtggaaccgggtgtggatcgaggacaacccctggatggaggacaagacccccgtcaccacctgggagaacgtgccctacctggggaagcgcgaggaccagtggtgcggcagcctgatcgggctcacgtcccgggccacctgggcccagaacatcccgaccgcgatccagcaggtccgcagcctgatcggcaacgaggagttcctggactacatgccctccatgaagcggttccgcaaggaggaggagagcgagggggccatctggtga

SEQ ID NO: 10236 - RNA, 9873 nt, synthetic construct
  misc_feature 1..9873: note = derived and/or modified CDS sequence (opt1) from DENV-3__FJ882578__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcatcctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatctcccgcaaggaccagcggggcagcggccaggtgggcacctacgggctgaacaccttcaccaacatggaggcccagctcatccgccagatggagggcgagggggtcctgtccaaggccgacctggagaacccccacctcccggagaagaagatcacgcagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcacgacctggtccatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10237 - RNA, 9873 nt, synthetic construct
  misc_feature 1..9873: note = derived and/or modified CDS sequence (opt1) from DENV-3__FJ639770__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacgtgatcggcgtcctcgagcagggcaagcgcaccctgacgctgcagcccatggagctcaagtactcctggaagacctgggggaaggccaagatcgtgaccgccgagacccagaacagctccttcatcatcgacggcccgaacacgcccgagtgccccagcgcctcccgggcgtggaacgtgtgggaggtcgaggactacgggttcggcgtgttcaccaccaacatctggctgaagctgcgcgaggtgtacacccagctctgcgaccaccggctgatgagcgccgccgtcaaggacgagcgcgccgtgcacgccgacatgggctactggatcgagagccagaagaacgggtcctggaagctggagaaggcgagcctcatcgaggtgaagacctgcacgtggcccaagtcccacaccctgtggagcaacggcgtcctggagtccgacatgatcatccccaagagcctcgccgggcccatctcccagcacaactaccggcccggctaccacacccagaccgccgggccgtggcacctgggcaagctggagctcgacttcaactactgcgagggcacgaccgtggtgatcaccgagaactgcgggacccgcggccccagcctgcggacgaccaccgtctccgggaagctgatccacgagtggtgctgccgcagctgcaccctgccgcccctccggtacatgggcgaggacgggtgctggtacggcatggagatccgcccgatctccgagaaggaggagaacatggtcaagagcctggtgtccgccggcagcggggaggtcgacaacttcacgatgggcgtgctctgcctggccatcctgttcgaggaggtgatgcgggggaagttcggcaagaagcacatgatcgcgggggtcttcttcaccttcgtgctcctgctgtccggccagatcacctggcgcgacatggcccacaccctcatcatgatcggcagcaacgcctccgaccggatggggatgggcgtgacgtacctggccctgatcgccaccttcaagatccagcccttcctcgcgctggggttcttcctgcgcaagctcaccagccgggagaacctgctgctcggcgtcggcctggccatggccaccacgctgcagctccccgaggacatcgagcagatggccaacgggatcgcgctgggcctgatggccctcaagctgatcacccagttcgagacctaccagctgtggaccgccctcatcagcctgacgtgctccaacaccatcttcaccctgaccgtggcctggcgcacggccaccctcatcctggcgggggtcagcctgctccccgtgtgccagtccagctccatgcggaagaccgactggctgccgatgaccgtggccgccatgggcgtgccgcccctgcccctcttcatcttcagcctgaaggacacgctgaagcgccgctcctggccgctcaacgagggggtgatggccgtgggcctggtcagcatcctggcctccagcctcctgcggaacgacgtgcccatggcgggccccctggtggccgggggcctcctgatcgcctgctacgtcatcaccgggacctccgccgacctgaccgtggagaaggccgcggacgtgacgtgggaggaggaggccgagcagaccggcgtcagccacaacctcatgatcaccgtggacgacgacgggaccatgcgcatcaaggacgacgagaccgagaacatcctgacggtgctgctcaagaccgccctgctgatcgtctccggcatcttcccctacagcatcccggccaccctcctggtgtggcacacctggcagaagcagacgcagcggtccggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacaccatgtggcacgtcacgcggggcgcggtgctgacctacaacgggaagcgcctggagccgaactgggcctccgtgaagaaggacctcatcagctacggcgggggctggcggctgtccgcccagtggcagaagggggaggaggtccaggtgatcgccgtggagcccggcaagaaccccaagaacttccagaccatgcccggcaccttccagacgaccaccggggagatcggcgcgatcgccctggacttcaagccggggaccagcggcagccccatcatcaaccgcgagggcaaggtcgtggggctgtacggcaacggggtggtcacgaagaacggcgggtacgtgtccggcatcgcccagaccaacgccgagcccgacggcccgacccccgagctcgaggaggagatgttcaagaagcggaacctgaccatcatggacctgcaccccgggagcggcaagacgcgcaagtacctccccgccatcgtgcgggaggcgatcaagcgccggctgcgcaccctgatcctcgccccgacccgggtcgtggccgccgagatggaggaggccctgaaggggctgcccatccgctaccagaccacggcgaccaagtccgagcacaccggccgggagatcgtggacctcatgtgccacgccaccttcacgatgcgcctgctgagccccgtccgggtgcccaactacaacctcatcatcatggacgaggcccacttcaccgacccggcctccatcgccgcgcgcgggtacatcagcacccgggtgggcatgggcgaggccgccgccatcttcatgaccgcgacgccgcccgggaccgccgacgccttcccccagtccaacgccccgatccaggacgaggagcgcgacatccccgagcgcagctggaactccggcaacgagtggatcaccgacttcgccgggaagaccgtctggttcgtgcccagcatcaaggcgggcaacgacatcgccaactgcctgcggaagaacgggaagaaggtgatccagctgtcccgcaagacgttcgacaccgagtaccagaagaccaagctcaacgactgggacttcgtcgtgaccacggacatcagcgagatgggcgccaacttcaaggccgaccgggtgatcgacccccgccggtgcctgaagccggtcatcctgaccgacggccccgagcgcgtgatcctcgccgggcccatgcccgtgaccgcggcctccgccgcccagcggcgcggccgggtcgggcgcaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgggagaagtccgccgccatcgacggcgagtaccgcctgaagggcgagtcccggaagaccttcgtggagctcatgcgccgcggggacctgcccgtctggctggcgcacaaggtggccagcgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacgtactccgaccccctcgccctgaaggagttcaaggacttcgccgcgggccgcaagagcatcgccctggacctcgtcaccgagatcgggcgggtgccgtcccacctggcccaccgcacccggaacgccctggacaacctcgtgatgctgcacaccagcgagcacggcgggaaggcctaccgccacgcggtcgaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggccgagatccccctgcagtggatcgccagcgcgatcgtgctcgagttcttcatgatggtcctgctgatcccggagcccgagaagcagcggacgccccaggacaaccagctcgcctacgtggtgatcgggatcctgaccctggccgccatcatcgccgcgaacgagatgggcctcctggagaccaccaagcgcgacctgggcatgtccaaggagcccggggtcgtgagcccgacgtcctacctcgacgtggacctgcaccccgccagcgcctggaccctgtacgccgtcgcgaccaccgtgatcacgcccatgctccggcacaccatcgagaactccaccgccaacgtgagcctggccgccatcgccaaccaggcggtcgtgctgatgggcctcgacaaggggtggcccatctccaagatggacctgggcgtgccgctgctcgccctggggtgctacagccaggtcaaccccctgaccctcacggccgccgtgctgctgctcatcacccactacgccatcatcggccccggcctgcaggcgaaggccacccgcgaggcccagaagcggaccgccgccgggatcatgaagaaccccacggtggacggcatcatgaccatcgacctggacccggtcatctacgactccaagttcgagaagcagctcggccaggtgatgctgctggtgctctgcgcggtccagctgctgctcatgcgcaccagctgggccctgtgcgaggccctgaccctcgccacgggccccatcaccaccctgtgggagggctcccccgggaagttctggaacaccacgatcgcggtgagcatggccaacatcttccggggctcctacctggccggggccggcctcgccttcagcatcatgaagtccgtggggaccggcaagcgcggcaccgggagccagggcgagaccctgggggagaagtggaagaagaagctgaaccagctcagccggaaggagttcgacctgtacaagaagtccggcatcaccgaggtcgaccgcacggaggcgaaggaggggctgaagcggggcgagatcacccaccacgccgtgagccgcggctccgccaagctccagtggttcgtggagcggaacatggtcatccccgaggggcgcgtgatcgacctgggctgcgggcggggcgggtggagctactactgcgccggcctgaagaaggtgaccgaggtccgcggctacaccaagggcgggccggggcacgaggagcccgtgcccatgtccacgtacggctggaacatcgtgaagctcatgagcgggaaggacgtcttctacctgcccccggagaagtgcgacaccctgctgtgcgacatcggcgagtccagcccctcccccaccgtggaggagagccggaccatccgcgtgctcaagatggtcgagccctggctgaagaacaaccagttctgcatcaaggtgctgaacccgtacatgcccacggtggtcgagcacctcgagcgcctgcagcggaagcacggcgggatgctggtgcgcaaccccctctcccggaacagcacccacgagatgtactggatctccaacggcaccgggaacatcgtggccagcgtcaacatggtgtcccgcctgctgctcaaccggttcaccatgacgcaccgccggcccaccatcgagaaggacgtggacctgggcgcgggcacccgccacgtcaacgccgagccggagacccccaacatggacgtgatcggggagcggatcaagcgcatcaaggaggagcacaacagcacgtggcactacgacgacgagaacccctacaagacctgggcctaccacggctcctacgaggtcaaggccaccgggagcgcctccagcatgatcaacggcgtggtgaagctgctcaccaagccgtgggacgtcgtgcccatggtgacgcagatggcgatgaccgacaccacccccttcgggcagcagcgggtcttcaaggagaaggtggacacgcgcacgccccggagcatgccgggcacccgccgggtgatgggcatcaccgccgagtggctgtggcgcaccctggggcggaacaagaagccccgcctctgcacccgggaggagttcaccaagaaggtccgcaccaacgccgccatgggcgcggtgttcacggaggagaaccagtgggactccgccaaggccgccgtggaggacgaggacttctggaagctggtcgaccgcgagcgggagctgcacaagctcgggaagtgcggcagctgcgtgtacaacatgatggggaagcgcgagaagaagctgggcgagttcggcaaggccaaggggtcccgggcgatctggtacatgtggctgggcgcccgctacctcgagttcgaggccctggggttcctgaacgaggaccactggttcagccgggagaactcctacagcggcgtggagggggagggcctccacaagctgggctacatcctgcgcgacatctccaagatccccgggggcgccatgtacgccgacgacaccgcggggtgggacacccggatcaccgaggacgacctccacaacgaggagaagatcacgcagcagatggaccccgagcaccgccagctggccaacgccatcttcaagctgacctaccagaacaaggtcgtgaaggtgcagcggccgacccccaccggcaccgtcatggacatcatcagccgcaaggaccagcggggctccggccaggtgggcacgtacgggctcaacaccttcaccaacatggaggcccagctgatccgccagatggagggcgagggggtgctgagcaaggccgacctcgagaacccccggctgcccgagaagaagatcacccagtggctggagacgaagggcgtcgagcgcctcaagcggatggcgatctccggcgacgactgcgtggtgaagccgatcgacgaccgcttcgccaacgccctgctggccctcaacgacatggggaaggtccggaaggacatcccccagtggcagcccagcaagggctggcacgactggcagcaggtccccttctgctcccaccacttccacgagctgatcatgaaggacgggcgcaagctggtggtcccgtgccggccccaggacgagctcatcggccgcgcccggatcagccagggggcgggctggtccctgcgcgagaccgcctgcctgggcaaggcctacgcccagatgtggagcctcatgtacttccaccgccgggacctgcgcctggcgtccaacgccatctgcagcgccgtgcccgtgcactgggtccccacctcccggaccacgtggagcatccacgcccaccaccagtggatgaccaccgaggacatgctcaccgtgtggaaccgcgtgtggatcgaggacaacccgtggatggaggacaagacgcccgtcaccacctgggagaacgtgccctacctggggaagcgggaggaccagtggtgcggcagcctgatcgggctcacctcccgcgccacgtgggcgcagaacatccccaccgccatccagcaggtccggagcctgatcggcaacgaggagttcctggactacatgccgtccatgaagcgcttccggaaggaggaggagagcgagggggccatctggtga

SEQ ID NO: 10238 - RNA, 9873 nt, synthetic construct
  misc_feature 1..9873: note = derived and/or modified CDS sequence (opt1) from DENV-3__FJ639771__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgcgcgagaacaacatcaagctgaccgtggtcgtgggggacgtgatcggcgtcctcgagcagggcaagcggaccctgacgccccagccgatggagctgaagtactcctggaagacctgggggaaggccaagatcgtgaccgccgagacccagaacagctccttcatcatcgacggccccaacacgcccgagtgccccagcgcctcccgcgcgtggaacgtgtgggaggtcgaggactacgggttcggcgtgttcaccaccaacatctggctcaagctgcgggaggtgtacacccagctgtgcgaccaccgcctcatgagcgccgccgtcaaggacgagcgggccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccgcccgggctaccacacccagaccgccgggccctggcacctcggcaagctggagctggacttcaactactgcgagggcacgaccgtggtgatcaccgagaactgcgggacccggggccccagcctccgcacgaccaccgtctccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcggggaggtcgacaacttcacgatgggcgtgctgtgcctcgccatcctgttcgaggaggtgatgcgcgggaagttcggcaagaagcacatgatcgcgggggtcttcttcaccttcgtgctgctcctgtccggccagatcacctggcgggacatggcccacaccctgatcatgatcggcagcaacgcctccgaccgcatggggatgggcgtgacgtacctcgccctgatcgccaccttcaagatccagcccttcctggcgctcgggttcttcctgcggaagctgaccagccgcgagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcggacggccaccctgatcctcgcgggggtcagcctgctgccggtgtgccagtccagctccatgcgcaagaccgactggctccccatgaccgtggccgccatgggcgtgccgcccctcccgctgttcatcttcagcctcaaggacacgctgaagcgccggtcctggcccctgaacgagggggtgatggccgtgggcctcgtcagcatcctggcctccagcctgctccgcaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgccaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgcggtgctcacctacaacgggaagcggctggagcccaactgggcctccgtgaagaaggacctgatcagctacggcgggggctggcgcctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgggagggcaaggtcgtggggctgtacggcaacggggtggtcacgaagaacggcgggtacgtgtccggcatcgcccagaccaacgccgagccggacggccccacccccgagctggaggaggagatgttcaagaagcgcaacctcaccatcatggacctgcaccccgggagcggcaagacgcggaagtacctgccggccatcgtgcgcgaggcgatcaagcggcgcctccggaccctgatcctggcccccacccgcgtcgtggccgccgagatggaggaggccctcaaggggctgcccatccggtaccagaccacggcgaccaagtccgagcacaccggccgcgagatcgtggacctgatgtgccacgccaccttcacgatgcggctcctgagccccgtccgcgtgccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtctggttcgtgcccagcatcaaggcgggcaacgacatcgccaactgcctccgcaagaacgggaagaaggtgatccagctgtcccggaagacgttcgacaccgagtaccagaagaccaagctgaacgactgggacttcgtcgtgaccacggacatcagcgagatgggcgccaacttcaaggccgaccgcgtgatcgacccgcggcgctgcctcaagcccgtcatcctgaccgacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggacttcgccgcgggccgcaagagcatcgccctggacctggtcaccgagatcgggcgcgtgccctcccacctcgcccaccggacccgcaacgccctggacaacctggtgatgctccacaccagcgagcacggcgggaaggcctaccggcacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcctcctgtggatggccgagatcccgctgcagtggatcgccagcgcgatcgtgctcgagttcttcatgatggtcctgctgatccccgagcccgagaagcagcgcacgccccaggacaaccagctcgcctacgtggtgatcgggatcctgaccctggccgccatcatcgccgcgaacgagatgggcctcctggagaccaccaagcgggacctgggcatgtccaaggagccgggggtcgtgagccccacgtcctacctcgacgtggacctgcaccccgccagcgcctggaccctgtacgccgtcgcgaccaccgtgatcacgcccatgctccgccacaccatcgagaactccaccgccaacgtgagcctggccgccatcgccaaccaggcggtcgtgctgatgggcctcgacaaggggtggccgatctccaagatggacctgggcgtgcccctgctcgccctggggtgctacagccaggtcaaccccctgaccctcacggccgccgtgctgctgctcatcacccactacgccatcatcggccccggcctgcaggcgaaggccacccgggaggcccagaagcgcaccgccgccgggatcatgaagaacccgacggtggacggcatcatgaccatcgacctggaccccgtcatctacgactccaagttcgagaagcagctcggccaggtgatgctgctggtgctctgcgcggtccagctgctgctcatgcggaccagctgggccctgtgcgaggccctgaccctcgccacgggccccatcaccaccctgtgggagggctcccccgggaagttctggaacaccacgatcgcggtgagcatggccaacatcttccgcggctcctacctggccggggccggcctcgccttcagcatcatgaagtccgtggggaccggcaagcggggcaccgggagccagggcgagaccctgggggagaagtggaagaagaagctgaaccagctcagccgcaaggagttcgacctgtacaagaagtccggcatcaccgaggtcgaccggacggaggcgaaggaggggctgaagcgcggcgagatcacccaccacgccgtgagccggggctccgccaagctccagtggttcgtggagcgcaacatggtcatcccggaggggcgggtgatcgacctgggctgcgggcgcggcgggtggagctactactgcgccggcctgaagaaggtgaccgaggtccggggctacaccaagggcgggcccgggcacgaggagcccgtgcccatgtccacgtacggctggaacatcgtgaagctcatgagcgggaaggacgtcttctacctgccgcccgagaagtgcgacaccctgctgtgcgacatcggcgagtccagcccctcccccaccgtggaggagagccgcaccatccgcgtgctcaagatggtcgagccgtggctgaagaacaaccagttctgcatcaaggtgctgaacccctacatgcccacggtggtcgagcacctcgagcggctgcagcgcaagcacggcgggatgctggtgcggaaccccctctcccgcaacagcacccacgagatgtactggatctccaacggcaccgggaacatcgtggccagcgtcaacatggtgtcccggctgctgctcaaccgcttcaccatgacgcaccggcgcccgaccatcgagaaggacgtggacctgggcgcgggcacccggcacgtcaacgccgagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtgaagctgctcaccaagccctgggacgtcgtgcccatggtgacgcagatggcgatgaccgacaccacccccttcgggcagcagcgcgtcttcaaggagaaggtggacacgcggaccccgcgcagcatgcccggcacccggcgcgtgatgggcatcaccgccgagtggctgtggcggacgctggggcgcaacaagaagccccggctctgcacccgcgaggagttcaccaagaaggtccgcaccaacgccgccatgggcgcggtgttcacggaggagaaccagtgggactccgccaaggccgccgtggaggacgaggacttctggaagctggtcgaccgggagcgcgagctgcacaagctcgggaagtgcggcagctgcgtgtacaacatgatggggaagcgggagaagaagctgggcgagttcggcaaggccaaggggtcccgcgcgatctggtacatgtggctgggcgcccggtacctcgagttcgaggccctggggttcctgaacgaggaccactggttcagccgcgagaactcctacagcggcgtggagggggagggcctccacaagctgggctacatcctgcgggacatctccaagatccccgggggcgccatgtacgccgacgacaccgcggggtgggacacccgcatcaccgaggacgacctccacaacgaggagaagatcacgcagcagatggacccggagcaccggcagctggccaacgccatcttcaagctgacctaccagaacaaggtcgtgaaggtgcagcgccccacccccaccggcaccgtcatggacatcatcagccggaaggaccagcgcggctccggccaggtgggcacgtacgggctcaacaccttcaccaacatggaggcccagctgatccggcagatggagggcgagggggtgctgagcaaggccgacctcgagaacccccgcctgccggagaagaagatcacccagtggctggagacgaagggcgtcgagcggctcaagcgcatggcgatctccggcgacgactgcgtggtgaagcccatcgacgaccggttcgccaacgccctgctggccctcaacgacatggggaaggtccgcaaggacatcccccagtggcagcccagcaagggctggcacgactggcagcaggtcccgttctgctcccaccacttccacgagctgatcatgaaggacgggcggaagctggtggtcccctgccgcccccaggacgagctcatcggccgggcccgcatcagccagggggcgggctggtccctgcgcgagaccgcctgcctgggcaaggcctacgcccagatgtggagcctcatgtacttccaccggcgcgacctgcggctggcgtccaacgccatctgcagcgccgtgcccgtgcactgggtcccgacctcccgcaccacgtggagcatccacgcccaccaccagtggatgaccaccgaggacatgctcaccgtgtggaaccgggtgtggatcgaggacaacccctggatggaggacaagacgcccgtcaccacctgggagaacgtgccctacctggggaagcgcgaggaccagtggtgcggcagcctgatcgggctcacctcccgggccacgtgggcgcagaacatcccgaccgccatccagcaggtccgcagcctgatcggcaacgaggagttcctggactacatgccctccatgaagcggttccgcaaggaggaggagagcgagggggccatctggtga

SEQ ID NO: 10239 - RNA, 9873 nt, synthetic construct
  misc_feature 1..9873: note = derived and/or modified CDS sequence (opt1) from DENV-3__FJ639772__SS-prME
  source 1..9873: mol_type = other RNA
accagcctgtgcctcatgatgatcctgcccgccgccctggcgttccacctcacctcccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcgtcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcggggaggtggacaacttcacgatgggcgtgctgtgcctcgcgatcctgttcgaggaggtcatgcgggggaagttcggcaagaagcacatgatcgccggggtgttcttcaccttcgtgctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggatccccatgaccgtcgccgccatgggcgtgccgcccctcccgctgttcatcttcagcctgaaggacacgctcaagcgccgctcctggcccctgaacgagggggtgatggccgtcggcctggtgagcatcctcgcgtccagcctgctgcggaacgacgtgcccatggccggccccctcgtcgccgggggcctgctgatcgcctgctacgtgatcaccgggacctccgccgacctcaccgtggagaaggcggccgacgtcacgtgggaggaggaggccgagcagaccggcgtgagccacaacctgatgatcaccgtggacgacgacgggaccatgcgcatcaaggacgacgagaccgagaacatcctgacggtcctcctgaagaccgccctgctcatcgtgtccggcatcttcccgtacagcatccccgccaccctgctggtgtggcacacctggcagaagcagacgcagcggtccggcgtcctctgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctgacctacaacgggaagcgcctcgagcccaactgggcctccgtcaagaaggacctgatcagctacggcgggggctggcggctgtccgcccagtggcagaagggggaggaggtccaggtgatcgcggtcgagcccggcaagaaccccaagaacttccagaccatgcccggcaccttccagacgaccaccggggagatcggcgccatcgccctcgacttcaagcccgggaccagcggcagccccatcatcaaccgcgagggcaagatcgtggggctgtacggcaacggggtggtcacgaagaacggcgggtacgtgtccggcatcgcccagaccaacgccgagccggacggccccacccccgagctggaggaggagatgttcaagaagcggaacctgaccatcatggacctccaccccgggagcggcaagacgcgcaagtacctgccggcgatcgtgcgggaggccatcaagcgccggctgcgcaccctcatcctggcccccacccgggtcgtggccgccgagatggaggaggcgctgaaggggctccccatccgctaccagacctccgccaccaagagcgagcacacgggccgggagatcgtggacctgatgtgccacgccaccttcaccatgcgcctgctctcccccgtccgggtgccgaactacaacctgatcatcatggacgaggcccacttcacggaccccgccagcatcgcggcccgcgggtacatctccacccgggtgggcatgggcgaggccgccgcgatcttcatgaccgccacgccgcccgggacggccgacgccttcccgcagagcaacgcccccatccaggacgaggagcgcgacatccccgagcgctcctggaacagcggcaacgagtggatcaccgacttcgcggggaagaccgtctggttcgtgccctccatcaaggccggcaacgacatcgccaactgcctgcggaagaacgggaagaaggtgatccagctcagccgcaagaccttcgacacggagtaccagaagaccaagctgaacgactgggacttcgtcgtgaccaccgacatctccgagatgggcgccaacttcaaggccgaccgggtgatcgacccgcgccggtgcctgaagcccgtcatcctcacggacggccccgagcgcgtgatcctggcggggcccatgccggtgaccgccgccagcgccgcccagcggcgcggccgggtcgggcgcaacccccagaaggagaacgaccagtacatcttcaccggccagcccctgaacaacgacgaggaccacgcgcactggaccgaggccaagatgctcctggacaacatcaacacccccgaggggatcatcccggccctgttcgagcccgagcgggagaagtccgccgcgatcgacggcgagtaccgcctcaagggcgagagccggaagacgttcgtggagctgatgcgccgcggggacctgcccgtgtggctcgcccacaaggtcgcctccgagggcatcaagtacaccgaccgcaagtggtgcttcgacgggcagcggaacaaccagatcctggaggagaacatggacgtggagatctggaccaaggagggcgagaagaagaagctgcgcccccggtggctcgacgcccgcacctacagcgacccgctggccctgaaggagttcaaggacttcgcggccggccgcaagtccatcgccctcgacctggtcacggagatcgggcgggtgcccacccacctggcccaccgcacccggaacgccctcgacaacctggtgatgctgcacaccagcgagcacggcgggaaggcgtaccgccacgccgtcgaggagctccccgagacgatggagaccctgctgctcctgggcctgatgatcctcctgaccgggggcgccatgctgttcctcatcagcggcaaggggatcggcaagacctccatcgggctgatctgcgtgatcgccagctccggcatgctgtggatggccgagatcccgctccagtggatcgcgagcgccatcgtgctggagttcttcatgatggtcctgctcatccccgagcccgagaagcagcggacgccccaggacaaccagctggcctacgtggtgatcgggatcctgaccctcgccgccatcatcgcggccaacgagatgggcctgctggagaccaccaagcgcgacctcggcatgtccaaggagccgggggtcgtgagccccacgtcctacctggacgtggacctgcaccccgccagcgcctggaccctctacgcggtcgccaccaccgtgatcacgcccatgctgcggcacaccatcgagaactccaccgccaacgtgagcctggccgccatcgcgaaccaggccgtcgtgctcatgggcctggacaaggggtggccgatctccaagatggacctgggcgtgcccctcctggccctggggtgctacagccaggtcaaccccctcaccctgacggccgccgtgctgctcctgatcacccactacgcgatcatcggccccggcctgcaggccaaggccacccgcgaggcccagaagcggaccgccgcggggatcatgaagaacccgacggtggacggcatcatgaccatcgacctcgaccccgtcatctacgactccaagttcgagaagcagctgggccaggtgatgctgctcgtgctgtgcgccgtccagctgctcctgatgcgcaccagctgggccctgtgcgaggccctcaccctggcgacgggccccatcaccaccctgtgggagggctcccccgggaagttctggaacaccacgatcgccgtgagcatggccaacatcttccggggctcctacctcgccggggccggcctggcgttcagcatcatgaagtccgtggggaccggcaagcgcggcaccgggagccagggcgagaccctgggggagaagtggaagaagaagctcaaccagctgagccggaaggagttcgacctgtacaagaagtccggcatcaccgaggtcgaccgcacggaggccaaggaggggctcaagcggggcgagatcacccaccacgccgtgagccgcggctccgccaagctgcagtggttcgtggagcggaacatggtcatcccggaggggcgcgtgatcgacctgggctgcgggcggggcgggtggagctactactgcgccggcctcaagaaggtgaccgaggtccgcggctacaccaagggcgggcccgggcacgaggagcccgtgcccatgtccacgtacggctggaacatcgtgaagctgatgagcgggaaggacgtcttctacctgccgcccgagaagtgcgacaccctcctgtgcgacatcggcgagtccagcccctcccccaccgtggaggagagccggaccatccgcgtgctgaagatggtcgagccgtggctgaagaacaaccagttctgcatcaaggtgctcaacccctacatgcccacggtgatcgagcacctggagcgcctgcagcggaagcacggcgggatgctcgtccgcaaccccctgtcccggaacagcacccacgagatgtactggatctccaacggcaccgggaacatcgtggcgagcgtgaacatggtctcccgcctgctcctgaaccggttcaccatgacgcaccgccggccgaccatcgagaaggacgtggacctgggcgccggcacccgccacgtgaacgccgagcccgagacccccaacatggacgtcatcggggagcggatcaagcgcatcaaggaggagcacaacagcacgtggcactacgacgacgagaacccgtacaagacctgggcctaccacggctcctacgaggtgaaggccaccgggagcgcgtccagcatgatcaacggcgtggtcaagctcctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgccgagtggctgtggcgcacgctcgggcggaacaagaagccccgcctgtgcacccgggaggagttcaccaagaaggtgcgcaccaacgccgcgatgggcgccgtcttcacggaggagaaccagtgggactccgccaaggccgccgtggaggacgaggacttctggaagctggtggaccgcgagcgggagctccacaagctggggaagtgcggcagctgcgtctacaacatgatggggaagcgcgagaagaagctgggcgagttcggcaaggcgaaggggtcccgggccatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgccatgtacgcggacgacaccgccgggtgggacacccggatcaccgaggacgacctgcacaacgaggagaagatcacgcagcagatggacccggagcaccgccagctggccaacgccatcttcaagctcacctaccagaacaaggtggtcaaggtgcagcggcccacccccaccggcaccgtgatggacatcatcagccgcaaggaccagcggggctccgggcaggtcggcacgtacgggctgaacaccttcaccaacatggaggcccagctgatccgccagatggagggcgagggggtgctcagcaaggcggacctggagaacccccacctccccgagaagaagatcacccagtggctggagacgaagggcgtggagcggctgaagcgcatggccatctccggcgacgactgcgtcgtgaagcccatcgacgaccggttcgccaacgccctgctcgccctgaacgacatggggaaggtgcgcaaggacatcccccagtggcagcccagcaagggctggcacgactggcagcaggtcccgttctgctcccaccacttccacgagctgatcatgaaggacgggcggaagctcgtggtgccctgccgcccccaggacgagctgatcggccgggcgcgcatcagccagggggccggctggtccctgcgggagaccgcctgcctcggcaaggcctacgcgcagatgtggagcctgatgtacttccaccgccgcgacctgcggctcgcctccaacgccatctgcagcgccgtccccgtgcactgggtgccgacctcccgcaccacgtggagcatccacgcccaccaccagtggatgaccaccgaggacatgctgaccgtctggaaccgggtgtggatcgaggacaacccctggatggaggacaagacgcccgtgaccacctgggagaacgtcccctacctggggaagcgcgaggaccagtggtgcggcagcctcatcgggctgacctcccgggcgacgtgggcccagaacatcccgaccgccatccagcaggtccgcagcctgatcggcaacgaggagttcctcgactacatgccctccatgaagcggttccgcaaggaggaggagagcgagggggccatctggtga

SEQ ID NO: 10240 - RNA, 9873 nt, synthetic construct
  misc_feature 1..9873: note = derived and/or modified CDS sequence (opt1) from DENV-3__FJ639774__SS-prME
  source 1..9873: mol_type = other RNA
accagcctctgcctcatgatgatcctgcccgcggcgctggcgttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcaccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcccacaacggccgcctgatcaccgcgaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggccaccgcgcggggcgcccgccggatggccatcctgggcgacacggcctgggacttcgggtccgtgggcggggtcctcaacagcctgggcaagatggtgcaccagatcttcgggtccgcctacaccgcgctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggccgactcccccaagcgcctcgcgacggccatcgccggcgcctgggagaacggggtgtgcggcatccgcagcaccacccggatggagaacctgctgtggaagcagatcgccaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcgaagatcgtcaccgccgagacgcagaacagctccttcatcatcgacggccccaacacccccgagtgccccaacgccagccgggcctggaacgtgtgggaggtggaggactacgggttcggcgtcttcaccaccaacatctggctcaagctgcgcgaggtgtacacccagctgtgcgaccaccggctcatgtccgcggccgtgaaggacgagcgcgccgtccacgccgacatgggctactggatcgagagccagaagaacgggagctggaagctggagaaggcctccctgatcgaggtgaagacgtgcacctggcccaagtcccacaccctctggtccaacggcgtgctggagagcgacatgatcatccccaagtccctggcggggcccatcagccagcacaactaccggccgggctaccacacccagacggccgggccctggcacctcggcaagctggagctggacttcaactactgcgagggcaccaccgtcgtgatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcagcgagaaggaggagaacatggtcaagtccctggtgagcgccggctccggggaggtggacaacttcaccatgggcgtcctgtgcctcgccatcctgttcgaggaggtgatgcgggggaagttcggcaagaagcacatgatcgccggggtgttcttcaccttcgtcctgctcctgagcggccagatcacctggcgcgacatggcgcacacgctgatcatgatcggctccaacgccagcgaccggatggggatgggcgtgacctacctcgccctgatcgccaccttcaagatccagcccttcctggccctcgggttcttcctgcgcaagctgacctcccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgcagcaacaccatcttcaccctgacggtcgcctggcgcaccgccaccctgatcctcgccggggtgtccctgctgccggtctgccagagctccagcatgcggaagaccgactggctccccatgacggtggcggccatgggcgtgccgcccctcccgctgttcatcttctccctcaaggacaccctgaagcgccgcagctggcccctgaacgagggggtcatggccgtgggcctcgtgtccatcctggccagctccctgctccggaacgacgtccccatggccggccccctggtggccggcgggctgctcatcgcctgctacgtgatcaccgggaccagcgccgacctgacggtcgagaaggccgccgacgtgacctgggaggaggaggcggagcagaccggggtgtcccacaacctgatgatcaccgtcgacgacgacgggaccatgcgcatcaaggacgacgagacggagaacatcctcaccgtgctgctgaagaccgccctcctgatcgtgagcggcatcttcccgtactccatccccgccaccctgctcgtctggcacacgtggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgccgtcctcacctacaacgggaagcgcctggagcccaactgggcgagcgtgaagaaggacctgatctcctacggcgggggctggcggctcagcgcccagtggcagaagggggaggaggtgcaggtcatcgccgtggagcccggcaagaaccccaagaacttccagaccatgcccggcacgttccagaccaccaccggggagatcggcgccatcgcgctggacttcaagcccgggacgtccggcagccccatcatcaaccgcgagggcaaggtggtcgggctgtacggcaacggggtggtgaccaagaacggcgggtacgtcagcggcatcgcccagaccaacgccgagccggacggccccacccccgagctggaggaggagatgttcaagaagcggaacctcacgatcatggacctgcaccccgggtccggcaagacccgcaagtacctgccggccatcgtgcgggaggccatcaagcgccggctccgcaccctgatcctggcgcccacccgggtggtcgccgccgagatggaggaggccctcaaggggctgcccatccgctaccagacgaccgccaccaagagcgagcacaccggccgggagatcgtggacctgatgtgccacgcgacgttcaccatgcgcctcctgtcccccgtgcgggtcccgaactacaacctgatcatcatggacgaggcccacttcaccgaccccgccagcatcgccgcccgcgggtacatctccacccgggtgggcatgggcgaggcggccgccatcttcatgacggccacgccgcccgggaccgcggacgccttcccgcagagcaacgcccccatccaggacgaggagcgcgacatccccgagcgctcctggaacagcggcaacgagtggatcaccgacttcgccgggaagacggtgtggttcgtcccctccatcaaggccggcaacgacatcgcgaactgcctccggaagaacgggaagaaggtgatccagctgagccgcaagaccttcgacaccgagtaccagaagaccaagctgaacgactgggacttcgtggtcacgaccgacatctccgagatgggcgccaacttcaaggccgaccgggtgatcgacccgcgccggtgcctcaagcccgtgatcctgaccgacggccccgagcgcgtcatcctggccgggcccatgccggtgaccgccgcgagcgccgcccagcggcgcggccgggtggggcgcaacccccagaaggagaacgaccagtacatcttcaccggccagcccctcaacaacgacgaggaccacgcccactggacggaggccaagatgctgctggacaacatcaacacccccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcccacaaggtcgcgtccgagggcatcaagtacaccgaccgcaagtggtgcttcgacgggcagcggaacaaccagatcctggaggagaacatggacgtggagatctggacgaaggagggcgagcgcaagaagctccggccccgctggctggacgcccgcacctacagcgacccgctggccctcaaggagttcaaggacttcgccgccggccggaagtccatcgcgctggacctggtgaccgagatcgggcgcgtccccacccacctcgcccaccggacgcgcaacgccctggacaacctggtgatgctccacaccagcgagcacggcgggaaggcctaccggcacgccgtggaggagctgcccgagaccatggagaccctgctcctgctgggcctcatgatcctgctgaccggcggggcgatgctgttcctgatctccgggaaggggatcggcaagaccagcatcgggctgatctgcgtcatcgccagctccggcatgctctggatggccgagatcccgctgcagtggatcgccagcgccatcgtgctggagttcttcatgatggtgctcctgatccccgagcccgagaagcagcgcacgccccaggacaaccagctggcgtacgtcgtgatcgggatcctcaccctggccgccatcatcgccgccaacgagatgggcctgctcgagacgaccaagcgggacctgggcatgtccaaggagccgggggtggtcagccccacctcctacctggacgtggacctccaccccgcgagcgcctggaccctgtacgccgtggccacgaccgtcatcacccccatgctgcgccacaccatcgagaactccacggcgaacgtgagcctcgccgccatcgccaaccaggccgtggtcctgatgggcctggacaaggggtggccgatctccaagatggacctcggcgtgcccctgctggcgctcgggtgctacagccaggtgaaccccctgaccctgaccgccgccgtcctcctgctgatcacccactacgccatcatcggccccggcctccaggccaaggcgacgcgggaggcccagaagcgcaccgccgccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcggacgagctgggcgctctgcgaggccctgaccctggccaccggccccatcaccacgctctgggagggctcccccgggaagttctggaacaccaccatcgccgtcagcatggcgaacatcttccgcggctcctacctggccggggccggcctggccttcagcatcatgaagtccgtggggaccggcaagcggggcaccgggagccagggcgagacgctcggggagaagtggaagaagaagctgaaccagctgtcccgcaaggagttcgacctctacaagaagtccggcatcaccgaggtggaccggaccgaggccaaggaggggctgaagcgcggcgagatcacccaccacgcggtcagccggggctccgccaagctgcagtggttcgtggagcgcaacatggtgatcccggaggggcgggtcatcgacctcggctgcgggcgcggcgggtggagctactactgcgccggcctgaagaaggtgacggaggtgcggggctacaccaagggcggccccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccacggtcgaggagagccgcaccatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcacgatgacccaccggcgcccgaccatcgagaaggacgtcgacctcggcgcgggcacccggcacgtgaacgccgagcccgagacgcccaacatggacgtgatcggggagcgcatcaagcggatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgcgtgttcaaggagaaggtggacacccggaccccgcgctccatgcccggcacccggcgcgtcatgggcatcacggccgagtggctctggcggaccctggggcgcaacaagaagccccggctgtgcacccgcgaggagttcaccaagaaggtgcgcacgaacgccgccatgggcgcggtgttcaccgaggagaaccagtgggacagcgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccggcacggtgatggacatcatcagccggaaggaccagcgcggctccggccaggtgggcacctacgggctgaacaccttcaccaacatggaggcccagctcatccggcagatggagggcgagggggtcctgagcaaggccgacctggagaacccccacctcccggagaagaagatcacgcagtggctggagaccaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtccactgggtgccgacctcccggacgacctggagcatccacgcccaccaccagtggatgaccaccgaggacatgctgacggtgtggaaccgcgtctggatcgaggacaacccctggatggaggacaagacccccgtgaccacctgggagaacgtgccctacctcgggaagcgggaggaccagtggtgcggctccctgatcgggctgacgagccgcgccacctgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10241 - RNA, 9873 nt, synthetic construct
  misc_feature 1..9873: note = derived and/or modified CDS sequence (opt1) from DENV-3__FJ639775__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggccatgggcatcaccgccgagtggctctggcgcacgctggggcggaacaagaagccccgcctgtgcacccgggaggagttcaccaagaaggtccgcaccaacgccgcgatgggcgccgtgttcacggaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggcgaaggggtcccgggccatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgcggacgacaccgccgggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggcggacctggagaacccccacctcccggagaagaagatcacccagtggctggagacgaagggcgtcgagcggctgaagcgcatggccatctccggcgacgactgcgtggtgaagcccatcgacgaccggttcgccaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcgcgcatcagccagggggccggctggtccctccgggagaccgcctgcctgggcaaggcctacgcgcagatgtggagcctgatgtacttccaccgccgcgacctccggctggcctccaacgccatctgcagcgccgtgcccgtgcactgggtcccgacctcccgcaccacgtggagcatccacgcccaccaccagtggatgaccaccgaggacatgctgaccgtgtggaaccgggtgtggatcgaggacaacccctggatggaggacaagacgcccgtcaccacctgggagaacgtgccctacctcgggaagcgcgaggaccagtggtgcggcagcctgatcgggctgacctcccgggcgacgtgggcccagaacatcccgaccgccatccagcaggtccgcagcctcatcggcaacgaggagttcctggactacatgccctccatgaagcggttccgcaaggaggaggagagcgagggggccatctggtga

SEQ ID NO: 10242 - RNA, 9873 nt, synthetic construct
  misc_feature 1..9873: note = derived and/or modified CDS sequence (opt1) from DENV-3__FJ639777__SS-prME
  source 1..9873: mol_type = other RNA
accagcctgtgcctcatgatgaccctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacgtacgggacctgcaaccaggccggcgagcaccggcgcgacaagcggtccgtcgccctcgcgccccacgtgggcatggggctggacacccgcacccagacgtggatgagcgccgagggcgcctggcgccaggtggagaaggtcgagacctgggccctgcgccacccggggttcaccatcctcgcgctgttcctggcccactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcgccgccgagacccagaacagctccttcatcatcgacggccccaacacgcccgagtgccccagcgcgtcccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgcgatcctgttcgaggaggtgatgcgggggaagctgggcaagaagcacatgatcgccggggtgttcttcaccttcgtcctcctgctgtccggccagatcacctggcgcgacatggcccacaccctcatcatgatcggcagcaacgcctccgaccggatggggatgggcgtgacgtacctggccctgatcgcgaccttcaagatccagcccttcctcgccctggggttcttcctgcgcaagctcaccagccgggagaacctgctgctcggcgtgggcctggccatggccaccacgctgcagctccccgaggacatcgagcagatggcgaacgggatcgccctgggcctgatggccctcaagctgatcacccagttcgagacctaccagctgtggaccgccctcatcagcctgacgtgctccaacaccatcttcaccctgaccgtcgcctggcgcacggcgaccctcatcctggccggggtgagcctgctcccggtctgccagtccagctccatgcggaagaccgactggctgcccatgaccgtggccgccatgggcgtgccgcccctgcccctcttcatcttcagcctgaaggacacgctgaagcgccgctcctggcccctcaacgagggggtcatggccgtgggcctggtgagcatcctggcgtccagcctcctgcggaacgacgtccccatggccggccccctggtggccgggggcctcctgatcgcctgctacgtgatcaccgggacctccgccgacctgaccgtcgagaaggcggccgacgtgacgtgggaggaggaggccgagcagaccggcgtgagccacaacctcatgatcaccgtcgacgacgacgggaccatgcgcatcaaggacgacgagaccgagaacatcctgacggtgctgctcaagaccgccctgctgatcgtgtccggcatcttcccgtacagcatccccgccaccctcctggtctggcacacctggcagaagcagacgcagcggtccggcgtgctgtgggacgtgcccagcccgcccgagacccagaaggcggagctcgaggagggggtctaccgcatcaagcagcagggcatcttcgggaagacccaggtgggcgtgggggtccagaaggagggcgtgttccacaccatgtggcacgtgacgcggggcgccgtcctgacctacaacgggaagcgcctggagcccaactgggcctccgtgaagaaggacctcatcagctacggcgggggctggcggctgaacgcccagtggcagaagggggaggaggtgcaggtcatcgcggtggagcccggcaagaaccccaagaacttccagaccatgcccggcaccttccagacgaccaccggggagatcggcgccatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctcgaggaggagatgttcaagaagcggaacctgaccatcatggacctgcaccccgggtccggcaagacgcgcaagtacctcccggcgatcgtgcgggaggccatcaagcgccggctgcgcaccctgatcctcgcccccacccgggtggtcgccgccgagatggaggaggcgctgaaggggctgcccatccgctaccagaccacggccaccaagagcgagcacaccggccgggagatcgtggacctcatgtgccacgccaccttcacgatgcgcctgctgtcccccgtgcgggtcccgaactacaacctcatcatcatggacgaggcccacttcaccgaccccgccagcatcgcggcccgcgggtacatctccacccgggtgggcatgggcgaggccgccgcgatcttcatgaccgccacgccgcccgggaccgccgacgccttcccgcagagcaacgcccccatccaggacgaggagcgcgacatccccgagcgctcctggaacagcggcaacgagtggatcaccgacttcgcggggaagaccgtgtggttcgtcccctccatcaaggccggcaacgacatcgccaactgcctgcggaagaacgggaagaaggtgatccagctgagccgcaagacgttcgacaccgagtaccagaagaccaagctcaacgactgggacttcgtggtcaccacggacatctccgagatgggcgccaacttcaaggccgaccgggtgatcgacccgcgccggtgcctgaagcccgtgatcctgaccgacggccccgagcgcgtcatcctcgcggggcccatcccggtgaccgccgccagcgccgcccagcggcgcggccgggtggggcgcaacccccagaaggagaacgaccagtacatcttcaccggccagcccctgaacaacgacgaggaccacgcgcactggaccgaggccaagatgctgctcgacaacatcaacacgcccgaggggatcatcccggccctgttcgagcccgagcgggagaagtccgccgcgatcgacggcgagtaccgcctgaagggcgagagccggaagaccttcgtcgagctcatgcgccgcggggacctgcccgtgtggctggcccacaaggtcgcctccgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacgtacagcgacccgctcgccctgaaggagttcaaggacttcgcggccggccgcaagtccatcgccctggacctcgtgaccgagatcgggcgggtccccagccacctggcccaccgcacccggaacgccctggacaacctcgtgatgctgcacacctccgagcacggcgggaaggcgtaccgccacgccgtggaggagctgcccgagacgatggagaccctcctgctgctcggcctgatgatcctgctcaccgggggcgccatgctgttcctgatcagcggcaaggggatcggcaagaccagcatcgggctcatctgcgtcatcgcctccagcggcatgctgtggatggccgagatcccgctgcagtggatcgcgtccgccatcgtgctcgagttcttcatgatggtgctgctgatccccgagcccgagaagcagcggacgccccaggacaaccagctcgcctacgtcgtgatcgggatcctgaccctggccgccatcatcgcggccaacgagatgggcctcctggagaccaccaagcgcgacctgggcatgagcaaggagccgggggtggtctcccccacgagctacctcgacgtggacctgcaccccgcctccgcctggaccctgtacgcggtggccaccaccgtcatcacgcccatgctccggcacaccatcgagaacagcaccgccaacgtgtccctggccgccatcgcgaaccaggccgtggtcctgatgggcctcgacaaggggtggccgatcagcaagatggacctgggcgtgcccctgctcgccctggggtgctactcccaggtgaaccccctgaccctcacggccgccgtcctgctgctcatcacccactacgcgatcatcggccccggcctgcaggccaaggccacccgcgaggcccagaagcggaccgccgcggggatcatgaagaacccgacggtggacggcatcatgaccatcgacctggaccccgtgatctacgacagcaagttcgagaagcagctcgggcaggtcatgctgctggtgctctgcgccgtgcagctgctgctcatgcgcacctcctgggccctgtgcgaggccctgaccctcgcgacgggccccatcaccaccctgtgggagggcagccccgggaagttctggaacaccacgatcgccgtctccatggccaacatcttccggggcagctacatcgccggggccggcctggcgttctccatcatgaagtccgtggggaccggcaagcgcggcaccgggtcccagggcgagaccctcggggagaagtggaagaagaagctgaaccagctgagccggaaggagttcgacctctacaagaagtccggcatcaccgaggtggaccgcacggaggccaaggaggggctgaagcggggcgagatcacccaccacgccgtctcccgcggcagcgccaagctgcagtggttcgtggagcggaacatggtgaccccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcagccccctgtcccggaacagcacccacgagatgtactggatctccaacggcaccgggaacatcgtcgcgagcgtgaacatggtgtcccgcctcctgctgaaccggttcacgatgacccaccgccggccgaccatcgagaaggacgtcgacctcggcgccggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcgtccagcatgatcaacggcgtggtcaagctgctgacgaagccctgggacgtggtgcccatggtcacccagatggccatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgcgatgggcgccgtgttcaccgaggagaaccagtgggactccgccaaggccgccgtcgaggacgaggacttctggaagctcgtggaccgcgagcgggagctgcaccgcctggggaagtgcggcagctgcgtgtacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgcggacgacaccgccgggtgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccggcacggtgatggacatcatcagccggaaggaccagcgcggctccggccaggtgggcacctacgggctgaacaccttcaccaacatggaggcccagctcatccggcagatggagggcgagggggtcctgagcaaggcggacctggagaacccccacctcccggagaagaagatcacgcagtggctggagaccaagggcgtggagcgcctgaagcggatggccatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcgcggatcagccagggggccggctggtccctccgcgagaccgcctgcctgggcaaggcctacgcgcagatgtggagcctgatgtacttccaccgccgggacctccgcctggcctccaacgccatctgcagcgccgtgcccgtccactgggtgccgacctcccggacgacctggagcatccacgcccaccaccagtggatgaccaccgaggacatgctgacggtgtggaaccgcgtctggatcgaggacaacccctggatggaggacaagacccccgtgaccacctgggagaacgtgccctacctcgggaagcgggaggaccagtggtgcggcagcctgatcgggctgacgtcccgcgcgacctgggcccagaacatcccgaccgccatccagcaggtccggagcctcatcggcaacgaggagttcctggactacatgccctccatgaagcgcttccggaaggaggaggagagcgagggggccatctggtga

SEQ ID NO: 10243 - RNA, 9873 nt, synthetic construct
  misc_feature 1..9873: note = derived and/or modified CDS sequence (opt1) from DENV-3__FJ639778__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggccgcatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccggctgatcacggccaaccccgtggtgaccaagaaggaggagcccgtcaacatcgaggccgagccgcccttcggggagagcaacatggtgatcggcatcggggacaacgccctgaagatcaactggtacaagaagggctccagcatcgggaagatgttcgaggcgaccgcccgcggcgcccggcgcatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccggagcacgacccgcatggagaacctgctgtggaagcagatcgcgaacgagctcaactacatcctgtgggagaacaacatcaagctgaccgtggtcgtgggggacatcatcggcgtgctcgagcagggcaagcggaccctgacgccccagccgatggagctgaagtactcctggaagacctgggggaaggccaagatcgtcaccgccgagacccagaacagctccttcatcatcgacggccccaacacgcccgagtgccccagcgcctcccgcgcgtggaacgtgtgggaggtggaggactacgggttcggcgtcttcaccaccaacatctggctcaagctgcgggaggtgtacacccagctgtgcgaccaccgcctcatgagcgccgccgtgaaggacgagcgggccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccgcccgggctaccacacccagaccgccgggccctggcacctcggcaagctggagctggacttcaactactgcgagggcacgaccgtcgtgatcaccgagaactgcgggacccggggccccagcctccgcacgaccaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcggggaggtggacaacttcacgatgggcgtcctgtgcctcgccatcctgttcgaggaggtgatgcgcgggaagttcggcaagaagcacatgatcgcgggggtgttcttcaccttcgtcctgctcctgtccggccagatcacctggcgggacatggcccacaccctgatcatgatcggcagcaacgcctccgaccgcatggggatgggcgtgacgtacctcgccctgatcgccaccttcaagatccagcccttcctggcgctcgggttcttcctgcggaagctgaccagccgcgagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcggacggccaccctgatcctcgcgggggtgagcctgctgccggtctgccagtccagctccatgcgcaagaccgactggctccccatgaccgtggccgccatgggcgtgccgcccctcccgctgttcatcttcagcctcaaggacacgctgaagcgccggtcctggcccctgaacgagggggtcatggccgtgggcctcgtgagcatcctggcctccagcctgctcaagaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgcggcgcggcgagatcacccaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccgcacgatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacccacgagatgtactggatcagcaacggcaccgggaacatcgtcgcctccgtgaacatggtgagccggctcctgctgaaccgcttcacgatgacccaccggcgcccgaccatcgagaaggacgtcgacctcggcgcgggcacccggcacgtgaacgccgagcccgagacgcccaacatggacgtgatcggggagcgcatcaagcggatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgcgtgttcaaggagaaggtggacacccggaccccgcgcagcatgcccggcacccggcgcgtcatgggcatcacggccgagtggctctggcggaccctggggcgcaacaagaagccccggctgtgcacccgcgaggagttcaccaagaaggtgcgcacgaacgccgccatgggcgcggtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccggcacggtgatggacatcatctcccggaaggaccagcgcggcagcggccaggtgggcacctacgggctgaacaccttcaccaacatggaggcccagctcatccggcagatggagggcgagggggtcctgtccaaggccgacctggagaacccccacctcccggagaagaagatcacgcagtggctggagaccaagggcgtggagcgcctgaagcggatggcgatcagcggcgacgactgcgtggtcaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggcgggctggagcctccgcgagaccgcctgcctgggcaaggcctacgcccagatgtggtccctgatgtacttccaccgccgggacctccgcctggcgagcaacgccatctgctccgccgtgcccgtccactgggtgccgaccagccggacgacctggtccatccacgcccaccaccagtggatgaccaccgaggacatgctgacggtgtggaaccgcgtctggatcgaggacaacccctggatggaggacaagacccccgtgaccacctgggagaacgtgccctacctcgggaagcgggaggaccagtggtgcggcagcctgatcgggctgacgagccgcgccacctgggcgcagaacatcccgaccgccatccagcaggtccggtccctcatcggcaacgaggagttcctggactacatgcccagcatgaagcgcttccggaaggaggaggagtccgagggggccatctggtga

SEQ ID NO: 10244 - RNA, 9873 nt, synthetic construct
  misc_feature 1..9873: note = derived and/or modified CDS sequence (opt1) from DENV-3__FJ639779__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagacggccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagcgcaaggcgcacaacggccggctgatcacggccaaccccgtggtgaccaagaaggaggagcccgtcaacatcgaggccgagccgcccttcggcgagagcaacatcgtgatcgggatcggcgacaacgccctgaagatcaactggtacaagaaggggtccagcatcggcaagatgttcgaggcgaccgcccgcggggcccggcgcatggccatcctgggcgacaccgcctgggacttcggctccgtcgggggcgtcctcaacagcctggggaagatggtgcaccagatcttcggctccgcgtacacggccctgttcagcggggtgtcctgggtcatgaagatcggcatcggcgtgctcctgacctggatcgggctgaacagcaagaacacctccatgagcttctcctgcatcgccatcggcatcatcaccctctacctgggggccgtggtccaggccgacatgggctgcgtgatcaactggaaggggaaggagctgaagtgcggcagcggcatcttcgtgacgaacgaggtccacacctggaccgagcagtacaagttccaggcggactcccccaagcgcctcgccaccgccatcgccggggcctgggagaacggcgtgtgcgggatccggagcacgacccgcatggagaacctgctgtggaagcagatcgcgaacgagctcaactacatcctgtgggagaacaacatcaagctgaccgtggtcgtgggcgacatcatcggggtgctcgagcagggcaagcggaccctgacgccccagccgatggagctgaagtactcctggaagacctggggcaaggccaagatcgtcaccgccgagacccagaacagctccttcatcatcgacgggcccaacacgcccgagtgccccagcgcctcccgcgcgtggaacgtgtgggaggtggaggactacggcttcggggtcttcaccaccaacatctggctcaagctgcgggaggtgtacacccagctgtgcgaccaccgcctcatgagcgccgccgtgaaggacgagcgggccgtccacgccgacatgggctactggatcgagagccagaagaacggctcctggaagctggagaaggcgagcctgatcgaggtgaagacctgcacgtggccgaagtcccacaccctctggagcaacggggtgctggagtccgacatgatcatccccaagagcctggccggccccatctcccagcacaactaccgcccggggtaccacacccagaccgccggcccctggcacctcgggaagctggagctggacttcaactactgcgagggcacgaccgtcgtgatcaccgagaactgcggcacccgggggcccagcctccgcacgaccaccgtgtccggcaagctgatccacgagtggtgctgccggagctgcaccctgcccccgctccgctacatgggggaggacggctgctggtacgggatggagatccggcccatctccgagaaggaggagaacatggtcaagagcctggtgtccgccggcagcggcgaggtggacaacttcacgatgggggtcctgtgcctcgccatcctgttcgaggaggtgatgcgcggcaagttcgggaagaagcacatgatcgcgggcgtgttcttcaccttcgtcctgctcctgtccgggcagatcacctggcgggacatggcccacaccctgatcatgatcggcagcaacgcctccgaccgcatgggcatgggggtgacgtacctcgccctgatcgccaccttcaagatccagcccttcctggcgctcggcttcttcctgcggaagctgaccagccgcgagaacctcctgctgggggtgggcctcgccatggccaccacgctgcagctgcccgaggacttcgagcagatggccaacggcatcgcgctcgggctgatggccctgaagctcatcacccagttcgagacctaccagctgtggaccgccctgatcagcctcacgtgctccaacaccatcttcaccctgaccgtcgcctggcggacggccaccctgatcctcgcgggcgtgagcctgctgccggtctgccagtccagctccatgcgcaagaccgactggctccccatgaccgtggccgccatgggggtgccgcccctcccgctgttcatcttcagcctcaaggacacgctgaagcgccggtcctggcccctgaacgagggcgtcatggccgtggggctcgtgagcatcctggcctccagcctgctccgcaacgacgtccccatggcgggccccctggtggccggcgggctgctcatcgcctgctacgtgatcaccggcacctccgccgacctgaccgtcgagaaggccgcggacgtgacgtgggaggaggaggccgagcagaccggggtgagccacaacctgatgatcaccgtcgacgacgacggcaccatgcggatcaaggacgacgagaccgagaacatcctcacggtgctgctgaagaccgccctcctgatcgtgtccgggatcttcccgtacagcatccccgccaccctgctcgtctggcacacctggcagaagcagacgcagcgctccggcgtgctgtgggacgtgcccagcccgcccgagacccagaaggccgagctggaggagggcgtctaccggatcaagcagcaggggatcttcggcaagacccaggtgggggtgggcgtccagaaggagggggtgttccacaccatgtggcacgtgacgcgcggcgcggtcctcacctacaacggcaagcggctggagcccaactgggcctccgtgaagaaggacctgatcagctacgggggcgggtggcgcctctccgcccagtggcagaagggcgaggaggtgcaggtcatcgccgtggagcccgggaagaaccccaagaacttccagaccatgcccggcaccttccagacgaccaccggcgagatcggggcgatcgccctggacttcaagcccggcaccagcgggagccccatcatcaaccgggagggcaaggtggtcggcctgtacgggaacggcgtggtgacgaagaacgggggctacgtctccgggatcgcccagaccaacgccgagccggacggccccgcccccgagctggaggaggagatgttcaagaagcgcaacctcaccatcatggacctgcaccccggcagcgggaagacccggaagtacctgccggcgatcgtgcgcgaggccatcaagcggcgcctccggacgctgatcctggcccccacccgcgtggtcgccgccgagatggaggaggcgctcaagggcctgcccatccggtaccagaccaccgccacgaagtccgagcacaccgggcgcgagatcgtggacctgatgtgccacgccaccttcaccatgcggctcctgagccccgtgcgcgtcccgaactacaacctgatcatcatggacgaggcccacttcacggaccccgcctccatcgcggcccggggctacatcagcacccgcgtggggatgggcgaggccgccgcgatcttcatgaccgccacgccgcccggcacggccgacgccttcccgcagtccaacgcccccatccaggacgaggagcgcgacatccccgagcggagctggaactccgggaacgagtggatcaccgacttcgcgggcaagaccgtgtggttcgtccccagcatcaaggccgggaacgacatcgccaactgcctccgcaagaacggcaagaaggtgatccagctgtcccggaagaccttcgacacggagtaccagaagaccaagctgaacgactgggacttcgtggtcaccaccgacatcagcgagatgggggccaacttcaaggccgaccgcgtgatcgacccgcggcgctgcctcaagcccgtgatcctgacggacggccccgagcgggtcatcctggcgggccccatgccggtgaccgccgcctccgccgcccagcgccgggggcgcgtgggccggaacccccagaaggagaacgaccagtacatcttcaccgggcagcccctcaacaacgacgaggaccacgcgcactggaccgaggccaagatgctgctggacaacatcaacacccccgagggcatcatcccggccctcttcgagcccgagcgcgagaagtccgccgcgatcgacggggagtaccggctgaagggcgagtcccgcaagacgttcgtcgagctgatgcggcgcggcgacctccccgtgtggctggcccacaaggtcgccagcgaggggatcaagtacaccgaccggaagtggtgcttcgacggccagcgcaacaaccagatcctggaggagaacatggacgtggagatctggaccaaggagggggagaagaagaagctccggccccgctggctggacgcccgcacctactccgacccgctggccctcaaggagttcaaggacttcgcggccggccgcaagagcatcgccctggacctggtgacggagatcggccgcgtccccacccacctcgcccaccggacccgcaacgccctggacaacctggtgatgctccacacctccgagcacgggggcaaggcgtaccggcacgccgtggaggagctgcccgagacgatggagaccctgctcctgctggggctcatgatcctgctgaccggcggggccatgctgttcctgatcagcggcaagggcatcgggaagaccagcatcggcctgatctgcgtcatcgcctccagcgggatgctctggatggccgagatcccgctgcagtggatcgcgtccgccatcgtgctggagttcttcatgatggtgctcctgatccccgagcccgagaagcagcgcacgccccaggacaaccagctggcctacgtcgtgatcggcatcctcaccctggccgccatcatcgcggccaacgagatggggctgctcgagaccaccaagcgggacctgggcatgagcaaggagccgggcgtggtctcccccacgagctacctggacgtggacctccaccccgcctccgcctggaccctgtacgcggtggccaccaccgtcatcacgcccatgctgcgccacaccatcgagaacagcaccgccaacgtgtccctcgccgccatcgcgaaccaggccgtggtcctgatggggctggacaagggctggccgatcagcaagatggacctcggggtgcccctgctggccctcggctgctactcccaggtgaaccccctgaccctgacggccgccgtcctcctgctgatcacccactacgcgatcatcgggcccggcctccaggccaaggccacccgggaggcccagaagcgcaccgccgcgggcatcatgaagaacccgacggtggacgggatcatgaccatcgacctggaccccgtgatctacgacagcaagttcgagaagcagctgggccaggtcatgctcctggtgctgtgcgccgtgcagctcctgctgatgcggacctcctgggccctctgcgaggccctgaccctggcgacggggcccatcaccaccctctgggagggcagccccggcaagttctggaacaccacgatcgccgtctccatggccaacatcttccgcgggagctacctggccggcgccgggctggcgttctccatcatgaagtccgtgggcaccgggaagcggggcaccggctcccagggggagaccctcggcgagaagtggaagaagaagctgaaccagctgagccgcaaggagttcgacctctacaagaagtccgggatcaccgaggtggaccggacggaggccaaggagggcctgaagcgcggggagatcacccaccacgccgtctcccggggcagcgccaagctgcagtggttcgtggagcgcaacatggtgatcccggagggccgggtcatcgacctcgggtgcggccgcgggggctggtcctactactgcgccgggctgaagaaggtgaccgaggtgcggggctacaccaagggcgggcccggccacgaggagcccgtccccatgagcacgtacgggtggaacatcgtgaagctgatgtccggcaaggacgtgttctacctcccgcccgagaagtgcgacaccctgctgtgcgacatcggggagagctcccccagccccaccgtcgaggagtcccgcaccatccgcgtgctgaagatggtggagccgtggctcaagaacaaccagttctgcatcaaggtcctgaacccctacatgcccacggtgatcgagcacctggagcggctccagcgcaagcacggcggcatgctggtgcggaaccccctgagccgcaactccacccacgagatgtactggatcagcaacgggaccggcaacatcgtcgcgtccgtgaacatggtgagccggctcctgctgaaccgcttcaccatgacgcaccggcgcccgaccatcgagaaggacgtcgacctcggggccggcacccggcacgtgaacgccgagcccgagacccccaacatggacgtgatcggcgagcgcatcaagcggatcaaggaggagcacaactccacgtggcactacgacgacgagaacccgtacaagacctgggcctaccacgggagctacgaggtcaaggccaccggctccgcgagctccatgatcaacggggtggtcaagctgctgaccaagccctgggacgtggtgcccatggtcacgcagatggccatgaccgacaccacccccttcggccagcagcgcgtgttcaaggagaaggtggacacgcggaccccgcgcagcatgcccgggacccggcgcgtcatgggcatcaccgccgagtggctctggcggacgctgggccgcaacaagaagccccggctgtgcacccgcgaggagttcaccaagaaggtgcgcaccaacgccgcgatgggggccgtgttcacggaggagaaccagtgggacagcgccaaggccgccgtcgaggacgaggacttctggaagctcgtggaccgggagcgcgagctgcacaagctgggcaagtgcgggtcctgcgtgtacaacatgatgggcaagcgggagaagaagctcggggagttcggcaaggcgaagggcagccgcgccatctggtacatgtggctgggggcccggtacctggagttcgaggccctcggcttcctgaacgaggaccactggttctcccgcgagaacagctactccggggtcgagggcgaggggctgcacaagctcggctacatcctgcgggacatcagcaagatccccggcggggccatgtacgcggacgacaccgccggctgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccgggaccgtgatggacatcatctcccggaaggaccagcgcggcagcggccaggtggggacgtacggcctgaacaccttcaccaacatggaggcccagctcatccggcagatggagggggagggcgtcctgtccaaggcggacctggagaacccccacctcccggagaagaagatcacccagtggctggagacgaagggggtggagcgcctgaagcggatggccatcagcggcgacgactgcgtggtcaagcccatcgacgaccgcttcgccaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcgcggatctcccagggcgccgggtggagcctccgcgagaccgcctgcctgggcaaggcctacgcgcagatgtggtccctgatgtacttccaccgccgggacctccgcctggccagcaacgccatctgctccgccgtgcccgtccactgggtgccgaccagccggaccacgtggtccatccacgcccaccaccagtggatgaccaccgaggacatgctgaccgtgtggaaccgcgtctggatcgaggacaacccctggatggaggacaagacgcccgtgaccacctgggagaacgtgccctacctcggcaagcgggaggaccagtggtgcgggagcctgatcggcctgaccagccgcgcgacgtgggcccagaacatcccgaccgccatccagcaggtccggtccctcatcgggaacgaggagttcctggactacatgcccgccatgaagcgcttccggaaggaggaggagagcgagggcgccatctggtga

SEQ ID NO: 10245 - RNA, 9873 nt, synthetic construct
  misc_feature 1..9873: note = derived and/or modified CDS sequence (opt1) from DENV-3__FJ639780__SS-prME
  source 1..9873: mol_type = other RNA
accagcctctgcctcatgatgatcctgcccgcggcgctggcgttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcaccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcccacaacggccgcctgatcaccgcgaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggccaccgcgcggggcgcccgccggatggccatcctgggcgacacggcctgggacttcgggtccgtgggcggggtcctcaacagcctgggcaagatggtgcaccagatcttcgggtccgcctacaccgcgctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggccgactcccccaagcgcctcgcgacggccatcgccggcgcctgggagaacggggtgtgcggcatccgcagcaccacccggatggagaacctgctgtggaagcagatcgccaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcgaagatcgtcaccgccgagacgcagaacagctccttcatcatcgacggccccaacacccccgagtgccccaacgccagccgggcctggaacgtgtgggaggtggaggactacgggttcggcgtcttcaccaccaacatctggctcaagctgcgcgaggtgtacacccagctgtgcgaccaccggctcatgtccgcggccgtgaaggacgagcgcgccgtccacgccgacatgggctactggatcgagagccagaagaacgggagctggaagctggagaaggcctccctgatcgaggtgaagacgtgcacctggcccaagtcccacaccctctggtccaacggcgtgctggagagcgacatgatcatccccaagtccctggcggggcccatcagccagcacaactaccggccgggctaccacacccagacggccgggccctggcacctcggcaagctggagctggacttcaactactgcgagggcaccaccgtcgtgatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcagcgagaaggaggagaacatggtcaagtccctggtgagcgccggctccggggaggtggacaacttcaccatgggcgtcctgtgcctcgccatcctgttcgaggaggtgatgcgggggaagttcggcaagaagcacatgatcgccggggtgttcttcaccttcgtcctgctcctgagcggccagatcacctggcgcgacatggcgcacacgctgatcatgatcggctccaacgccagcgaccggatggggatgggcgtgacctacctcgccctgatcgccaccttcaagatccagcccttcctggccctcgggttcttcctgcgcaagctgacctcccgggagaacctcctgctgggcgtgggcctcgcgatggccacgaccctgcagctgcccgaggacatcgagcagatggccaacgggatcgccctcggcctgatggcgctgaagctcatcacccagttcgagacctaccagctgtggacggccctgatcagcctgacctgcagcaacaccatcttcaccctgacggtcgcctggcgcaccgccaccctgatcctcgccggggtgtccctgctgccggtctgccagagctccagcatgcggaagaccgactggctccccatgacggtggcggccatgggcatcccgcccctcccgctgttcatcttctccctcaaggacaccctgaagcgccgcagctggcccctgaacgagggggtgatggccgtcggcctcgtgtccatcctggccagctccctgctccggaacgacgtgcccatggccggccccctggtcgccggcgggctgctcatcgcctgctacgtgatcaccgggaccagcgccgacctgacggtggagaaggccgccgacgtcacctgggaggaggaggcggagcagaccggggtgtcccacaacctgatgatcaccgtggacgacgacgggaccatgcgcatcaaggacgacgagacggagaacatcctcaccgtcctgctgaagaccgccctcctgatcgtgagcggcatcttcccgtactccatccccgccaccctgctcgtgtggcacacgtggcagaagcagacccagcggagcggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacacgatgtggcacgtgacccggggcgccgtgctcacctacaacgggaagcgcctggagcccaactgggcgagcgtcaagaaggacctgatctcctacggcgggggctggcggctcagcgcccagtggcagaagggggaggaggtccaggtgatcgccgtcgagcccggcaagaaccccaagaacttccagaccatgcccggcacgttccagaccaccaccggggagatcggcgccatcgcgctggacttcaagcccgggacgtccggcagccccatcatcaaccgcgagggcaaggtggtggggctgtacggcaacggggtcgtgaccaagaacggcgggtacgtgagcggcatcgcccagaccaacgccgagccggacggccccacccccgagctggaggaggagatgttcaagaagcggaacctcacgatcatggacctgcaccccgggtccggcaagacccgcaagtacctgccggccatcgtccgggaggccatcaagcgccggctccgcaccctgatcctggcgcccacccgggtggtggccgccgagatggaggaggccctcaaggggctgcccatccgctaccagacgaccgccaccaagagcgagcacaccggccgggagatcgtcgacctgatgtgccacgcgacgttcaccatgcgcctcctgtcccccgtgcgggtgccgaactacaacctgatcatcatggacgaggcccacttcaccgaccccgccagcatcgccgcccgcgggtacatctccacccgggtcggcatgggcgaggcggccgccatcttcatgacggccacgccgcccgggaccgcggacgccttcccgcagagcaacgcccccatccaggacgaggagcgcgacatccccgagcgctcctggaacagcggcaacgagtggatcaccgacttcgccgggaagacggtgtggttcgtgccctccatcaaggccggcaacgacatcgcgaactgcctccggaagaacgggaagaaggtcatccagctgagccgcaagaccttcgacaccgagtaccagaagaccaagctgaacgactgggacttcgtggtgacgaccgacatctccgagatgggcgccaacttcaaggccgaccgggtcatcgacccgcgccggtgcctcaagcccgtgatcctgaccgacggccccgagcgcgtgatcctggccgggcccatgccggtcaccgccgcgagcgccgcccagcggcgcggccgggtggggcgcaacccccagaaggagaacgaccagtacatcttcaccggccagcccctcaacaacgacgaggaccacgcccactggacggaggccaagatgctgctggacaacatcaacacccccgaggggatcatcccggccctcttcgagcccgagcgggagaagtccgccgccatcgacggcgagtaccgcctgaagggcgagagccggaagaccttcgtggagctgatgcgccgcggggacctccccgtctggctggcccacaaggtggcgtccgagggcatcaagtacaccgaccgcaagtggtgcttcgacgggcagcggaacaaccagatcctggaggagaacatggacgtcgagatctggacgaaggagggcgagcgcaagaagctccggccccgctggctggacgcccgcacctacagcgacccgctggccctcaaggagttcaaggacttcgccgccggccggaagtccatcgcgctggacctggtgaccgagatcgggcgcgtgcccacccacctcgcccaccggacgcgcaacgccctggacaacctggtcatgctccacaccagcgagcacggcgggaaggcctaccggcacgccgtggaggagctgcccgagaccatggagaccctgctcctgctgggcctcatgatcctgctgaccggcggggcgatgctgttcctgatctccgggaaggggatcggcaagaccagcatcgggctgatctgcgtgatcgccagctccggcatgctctggatggccgagatcccgctgcagtggatcgccagcgccatcgtcctggagttcttcatgatggtgctcctgatccccgagcccgagaagcagcgcacgccccaggacaaccagctggcgtacgtggtcatcgggatcctcaccctggccgccatcatcgccgccaacgagatgggcctgctcgagacgaccaagcgggacctgggcatgtccaaggagccgggggtggtgagccccacctcctacctggacgtcgacctccaccccgcgagcgcctggaccctgtacgccgtggccacgaccgtgatcacccccatgctgcgccacaccatcgagaactccacggcgaacgtcagcctcgccgccatcgccaaccaggccgtggtgctgatgggcctggacaaggggtggccgatctccaagatggacctcggcgtccccctgctggcgctcgggtgctacagccaggtgaaccccctgaccctgaccgccgccgtgctcctgctgatcacccactacgccatcatcggccccggcctccaggccaaggcgacgcgggaggcccagaagcgcaccgccgccgggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcggacgagctgggcgctctgcgaggccctgaccctggccaccggccccatcaccacgctctgggagggctcccccgggaagttctggaacaccaccatcgccgtgagcatggcgaacatcttccgcggctcctacctggccggggccggcctggccttcagcatcatgaagtccgtcgggaccggcaagcggggcaccgggagccagggcgagacgctcggggagaagtggaagaagaagctgaaccagctgtcccgcaaggagttcgacctctacaagaagtccggcatcaccgaggtggaccggaccgaggccaaggaggggctgaagcgcggcgagatcacccaccacgcggtgagccggggctccgccaagctgcagtggttcgtcgagcgcaacatggtgatcccggaggggcgggtgatcgacctcggctgcgggcgcggcgggtggagctactactgcgccggcctgaagaaggtcacggaggtgcggggctacaccaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccacggtggaggagagccgcaccatccgcgtcctgaagatggtggagccgtggctcaagaacaaccagttctgcatcaaggtgctgaacccctacatgcccgccgtcatcgagcacctggagcggctccagcgcaagcacggcgggatgctggtgcggaaccccctgtcccgcaacagcacccacgagatgtactggatctccaacggcaccgggaacatcgtggccagcgtcaacatggtgtcccggctcctgctgaaccgcttcacgatgacccaccggcgcccgaccatcgagaaggacgtggacctcggcgcgggcacccggcacgtcaacgccgagcccgagacgcccaacatggacgtgatcggggagcgcatcaagcggatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggcgatgaccgacaccacgcccttcgggcagcagcgcgtcttcaaggagaaggtggacacccggaccccgcgctccatgcccggcacccggcgcgtgatgggcatcacggccgagtggctctggcggaccctggggcgcaacaagaagccccggctgtgcacccgcgaggagttcaccaagaaggtccgcacgaacgccgccatgggcgcggtgttcaccgaggagaaccagtgggacagcgccaaggccgccgtggaggacgaggacttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtcgtgaaggtgcagcgccccacccccaccggcacggtcatggacatcatcagccggaaggaccagcgcggctccggccaggtgggcacctacgggctgaacaccttcaccaacatggaggcccagctcatccggcagatggagggcgagggggtgctgagcaaggccgacctggagaacccccacctcccggagaagaagatcacgcagtggctggagaccaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtgcactgggtcccgacctcccggacgacctggagcatccacgcccaccaccagtggatgaccaccgaggacatgctgacggtgtggaaccgcgtgtggatcgaggacaacccctggatggaggacaagacccccgtcaccacctgggagaacgtgccctacctcgggaagcgggaggaccagtggtgcggctccctgatcgggctgacgagccgcgccacctgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10246 - RNA, 9873 nt, synthetic construct
  misc_feature 1..9873: note = derived and/or modified CDS sequence (opt1) from DENV-3__FJ639781__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccagtacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacatctccatgagcttctcctgcatcgccatcgggatcatcaccctctacctgggcgccgtggtccaggccgacatggggtgcgtgatcaactggaagggcaaggagctgaagtgcggcagcgggatcttcgtgaccaacgaggtccacacgtggaccgagcagtacaagttccaggcggactcccccaagcgcctcgccaccgccatcgccggcgcctgggagaacggggtgtgcggcatccgcagcaccacgcggatggagaacctgctgtggaagcagatcgcgaacgagctcaactacatcctgtgggagaacaacatcaagctgaccgtggtcgtgggggacaccatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgccctgctcctgtccggccagatcacctggcgcgacatggcccacaccctgatcatgatcggcagcaacgcctccgaccggatggggatgggcgtcacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatcagcctcacgtgctccaacaccatcttcaccctgaccgtggcctggcgcacggcgaccctgatcctcgccggggtcagcctgctgccggtgtgccagtccagctccatgcggaagaccgactggctccccatgaccgtcgccgccatgggcgtgccgcccctcccgctgttcatcttcagcctcaaggacacgctgaagcgccgctcctggcccctgaacgagggggtgatggccgtcggcctcgtgagcatcctggcgtccagcctgctccggaacgacgtgcccatggccggccccctggtcgccgggggcctgctcatcgcctgctacgtgatcaccgggacctccgccgacctgaccgtggagaaggcggccgacgtcacgtgggaggaggaggccgagcagaccggcgtgagccacaacctgatgatcaccgtggacgacgacgggaccatgcgcatcaaggacgacgagaccgagaacatcctcacggtcctgctgaagaccgccctcctgatcgtgtccggcatcttcccgtacagcatccccgccaccctgctcgtgtggcacacctggcagaagcagacgcagcggtccggcgtcctgtgggacgtgcccagcccgcccgagacccagaaggcggagctggaggagggggtgtaccgcatcaagcagcagggcatcttcgggaagacccaggtcggcgtgggggtgcagaaggagggcgtcttccacaccatgtggcacgtgacgcggggcgccgtgctcacctacaacgggaagcgcctggagcccaactgggcctccgtcaagaaggacctgatcagctacggcgggggctggcggctctccgcccagtggcagaagggggaggaggtccaggtgatcgcggtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggcgatcgtccgggaggccatcaagcgccggctccgcaccctgatcctggcccccacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgaccgccacgccgcccgggaccgccgacgccttcccgcagtccaacgcccccatccaggacgaggagcgcgacatccccgagcgcagctggaactccggcaacgagtggatcaccgacttcgcggggaagaccgtgtggttcgtgcccagcatcaaggccggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggaccgaggccaagatgctgctggacaacatcaacacgcccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgcggccggccgcaagagcatcgccctggacctggtgaccgagatcgggcgggtgcccacccacctcgcccaccgcacccggaacgccctggacaacctggtcatgctccacacgtccgagcacggcgggaaggcgtaccgccacgccgtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcgtccgccatcgtcctggagttcttcatgatggtgctcctgatccccgagcccgagaagcagcggacgccccaggacaaccagctggcctacgtggtcatcgggatcctcaccctggccgccaccatcgcggccaacgagatgggcctgctcgagacgaccaagcgcgacctgggcatgagcaaggagccgggggtggtgtcccccaccagctacctggacgtcgacctccaccccgcctccgcctggaccctgtacgcggtggccacgaccgtgatcacccccatgctgcggcacaccatcgagaacagcacggccaacgtctccctcgccgccatcgcgaaccaggccgtggtgctgatgggcctggacaaggggtggccgatcagcaagatggacctcggcgtccccctgctggccctcgggtgctactcccaggtgaaccccctgaccctgaccgccgccgtgctcctgctgatcacccactacgcgatcatcggccccggcctccaggccaaggccacgcgcgaggcccagaagcggaccgccgcggggatcatgaagaacccgaccgtcgacggcatcatgaccatcgacctggaccccgtgatctacgacagcaagttcgagaagcagctgggccaggtgatgctcctggtcctgtgcgccgtgcagctcctgctgatgcgcacgtcctgggccctctgcgaggccctgaccctggcgaccggccccatcaccacgctctgggagggcagccccgggaagttctggaacaccaccatcgccgtgtccatggccaacatcttccggggcagctacctggccggggccggcctggcgttctccatcatgaagtccgtcgggaccggcaagcgcggcaccgggtcccagggcgagacgctcggggagaagtggaagaagaagctgaaccagctgagccggaaggagttcgacctctacaagaagtccggcatcaccgaggtggaccgcaccgaggccaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcacggaggtgcgcggctacaccaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccacggtggaggagtcccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcacggggaacatcgtggcgtccgtcaacatggtgagccgcctcctgctgaaccggttcaccatgacccaccgccggccgaccatcgagaaggacgtggacctcggcgccggcacgcgccacgtcaacgccgagcccgagacccccaacatggacgtgatcggggagcggatcaagcgcatcaaggaggagcacaactccacctggcactacgacgacgagaacccgtacaagacctgggcctaccacggcagctacgaggtgaaggccacggggtccgcgagctccatgatcaacggcgtcgtgaagctgctgaccaagccctgggacgtcgtgcccatggtgacccagatggccatgaccgacacgacccccttcgggcagcagcgggtcttcaaggagaaggtggacacccgcaccccgcggagcatgcccggcacgcgccgggtgatgggcatcaccgccgagtggctctggcgcaccctggggcggaacaagaagccccgcctgtgcacccgggaggagttcacgaagaaggtccgcaccaacgccgcgatgggcgccgtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacgcggatcaccgaggacgacctgcacaacgaggagaagatcacccagcagatggacccggagcaccgccagctcgccaacgccatcttcaagctgacctaccagaacaaggtcgtgaaggtgcagcggcccacccccacgggcaccgtcatggacatcatctcccgcaaggaccagcggggcagcggccaggtgggcacctacgggctgaacaccttcacgaacatggaggcccagctcatccgccagatggagggcgagggggtgctgtccaaggcggacctggagaacccccacctcccggagaagaagatcacccagtggctggagaccaagggcgtcgagcggctgaagcgcatggccatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtgcccgtgcactgggtcccgacgagccgcaccacctggtccatccacgcccaccaccagtggatgaccacggaggacatgctgaccgtgtggaaccgggtgtggatcgaggacaacccctggatggaggacaagacccccgtcaccacgtgggagaacgtgccctacctcgggaagcgcgaggaccagtggtgcggcagcctgatcgggctgaccagccgggcgacctgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 10247 - RNA, 9873 nt, synthetic construct
  misc_feature 1..9873: note = derived and/or modified CDS sequence (opt1) from DENV-3__FJ639782__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaagatcgtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgcccacccacctcgcccaccgcacccggaacgccctggacaacctggtcatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcggacgccccaggacaaccagctggcctacgtggtcatcgggatcctcaccctggccgccaccatcgccgcgaacgagatgggcctgctcgagacgaccaagcgcgacctgggcatgagcaaggagccgggggtggtgtcccccaccagctacctggacgtcgacctccaccccgcctccgcctggaccctgtacgccgtggcgacgaccgtgatcacccccatgctgcggcacaccatcgagaacagcacggccaacgtctccctcgccgccatcgccaaccaggcggtggtgctgatgggcctggacaaggggtggccgatcagcaagatggacctcggcgtccccctgctggccctcgggtgctactcccaggtgaaccccctgaccctgaccgccgccgtgctcctgctgatcacccactacgccatcatcggccccggcctccaggcgaaggccacgcgcgaggcccagaagcggaccgccgccgggatcatgaagaacccgaccgtcgacggcatcatgaccatcgacctggaccccgtgatctacgacagcaagttcgagaagcagctgggccaggtgatgctcctggtcctgtgcgcggtgcagctcctgctgatgcgcacgtcctgggccctctgcgaggccctgaccctggccaccggccccatcaccacgctctgggagggcagccccgggaagttctggaacaccaccatcgcggtgtccatggccaacatcttccggggcagctacctggccggggccggcctggccttctccatcatgaagtccgtcgggaccggcaagcgcggcaccgggtcccagggcgagacgctcggggagaagtggaagaagaagctgaaccagctgagccggaaggagttcgacctctacaagaagtccggcatcaccgaggtggaccgcaccgaggcgaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcacggaggtgcgcggctacaccaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccacggtggaggagtcccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcacggggaacatcgtggcctccgtcaacatggtgagccgcctcctgctgaaccggttcaccatgacctaccgccggccgaccatcgagaaggacgtggacctcggcgcgggcacgcgccacgtcaacgccgagcccgagacccccaacatggacgtgatcggggagcggatcaagcgcatcaaggaggagcacaactccacctggcactacgacgacgagaacccgtacaagacctgggcctaccacggcagctacgaggtgaaggccacggggtccgccagctccatgatcaacggcgtcgtgaagctgctgaccaagccctgggacgtcgtgcccatggtgacccagatggcgatgaccgacacgacccccttcgggcagcagcgggtcttcaaggagaaggtggacacccgcaccccgcggagcatgcccggcacgcgccgggtgatgggcatcaccgccgagtggctctggcgcaccctggggcggaacaagaagccccgcctgtgcacccgggaggagttcacgaagaaggtccgcaccaacgccgccatgggcgcggtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtcgtgaaggtgcagcggcccacccccacgggcaccgtcatggacatcatctcccgcaaggaccagcggggcagcggccaggtgggcacctacgggctgaacaccttcacgaacatggaggcccagctcatccgccagatggagggcgagggggtgctgtccaaggccgacctggagaacccccacctcccggagaagaagatcacccagtggctggagaccaagggcgtcgagcggctgaagcgcatggcgatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtgcactgggtcccgacgagccgcaccacctggtccatccacgcccaccaccagtggatgaccacggaggacatgctgaccgtgtggaaccgggtgtggatcgaggacaacccctggatggaggacaagacccccgtcaccacgtgggagaacgtgccctacctcgggaagcgcgaggaccagtggtgcggcagcctgatcgggctgaccagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10248 - RNA, 9873 nt, synthetic construct
  misc_feature 1..9873: note = derived and/or modified CDS sequence (opt1) from DENV-3__FJ639785__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtccccacccacctcgcccaccgcacgcggaacgccctggacaacctggtgatgctccacacctccgagcacggcgggaaggcctaccgccacgcggtggaggagctgcccgagaccatggagaccctgctcctgctgggcctcatgatcctgctgaccggcggggccatgctgttcctgatcagcgggaaggggatcggcaagaccagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccacgatcgccgcgaacgagatgggcctgctcgagaccaccaagcgcgacctgggcatgagcaaggagccgggggtggtctcccccaccagctacctggacgtggacctccaccccgcctccgcctggacgctgtacgccgtggcgaccaccgtcatcacccccatgctgcggcacacgatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtgatctacgacagcaagttcgagaagcagctggggcaggtcatgctcctggtgctgtgcgcggtgcagctcctgctgatgcgcacctcctgggccctctgcgaggccctgaccctggccaccggccccatcacgaccctctgggagggcagccccgggaagttctggaacaccaccatcgcggtctccatggccaacatcttccggggcagctacctggccggggccggcctggccttctccatcatgaagtccgtggggaccggcaagcgcggcacggggtcccagggcgagaccctcggggagaagtggaagaagaagctgaaccagctgagccggaaggagttcgacctctacaagaagtccggcatcaccgaggtggaccgcaccgaggcgaaggaggggctgaagcggggcgagatcacgcaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacgcacgagatgtactggatcagcaacggcaccgggaacatcgtcgcctccgtgaacatggtgagccgcctcctgctgaaccggttcaccatgacccaccgccggccgacgatcgagaaggacgtcgacctcggcgcgggcacccgccacgtgaacgccgagcccgagacccccaacatggacgtgatcggggagcggatcaagcgcatcaaggaggagcacaactccacctggcactacgacgacgagaacccgtacaagacgtgggcctaccacggcagctacgaggtcaaggccaccgggtccgccagctccatgatcaacggcgtggtcaagctgctgaccaagccctgggacgtggtgcccatggtcacccagatggcgatgacggacaccacccccttcgggcagcagcgggtgttcaaggagaaggtggacacccgcacgccgcggagcatgcccggcacccgccgggtcatgggcatcaccgccgagtggctctggcgcaccctggggcggaacaagaagccccgcctgtgcacgcgggaggagttcaccaagaaggtgcgcaccaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacctaccagaacaaggtggtgaaggtccagcggcccacgcccaccggcaccgtgatggacatcatctcccgcaaggaccagcggggcagcggccaggtgggcacctacgggctgaacacgttcaccaacatggaggcccagctcatccgccagatggagggcgagggggtcctgtccaaggccgacctggagaacccccacctcccggagaagaagatcacccagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagacggcctgcctgggcaaggcctacgcccagatgtggtccctgatgtacttccaccgccgcgacctccggctggcgagcaacgccatctgctccgccgtgcccgtccactgggtgccgaccagccgcaccacctggtccatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggcagcctgatcgggctgaccagccgggccacctgggcgcagaacatcccgacggccatccagcaggtccgctccctcatcggcaacgaggagttcctggactacatgcccagcatgaagcggttccgcaaggaggaggagtccgagggggccatctggtga

SEQ ID NO: 10249 - RNA, 9873 nt, synthetic construct
  misc_feature 1..9873: note = derived and/or modified CDS sequence (opt1) from DENV-3__FJ639786__SS-prME
  source 1..9873: mol_type = other RNA
accagcctctgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctgggccagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcccacaacggccgcctgatcaccgccaaccccgtggtgacgaagaaggaggagcccgtcaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctgggtcatgaagatcggcatcggggtgctcctgacgtggatcggcctgaacagcaagaacacctccatgagcttctcctgcatcgccatcgggatcatcaccctctacctgggcgccgtggtccaggcggacatggggtgcgtgatcaactggaagggcaaggagctgaagtgcggcagcgggatcttcgtgaccaacgaggtccacacgtggaccgagcagtacaagttccaggccgactcccccaagcgcctcgccaccgccatcgccggcgcgtgggagaacggggtgtgcggcatccgcagcaccacgcggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtactcctggaagacgtgggggaaggccaagatcgtcaccgccgagacccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacatggcccacaccctgatcatgatcggcagcaacgcctccgaccggatggggatgggcgtgacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatcttcaccctgaccgtcgcctggcgcaccgcgacgctgatcctcgccggggtgagcctgctgccggtctgccagtccagctccatgcggaagaccgactggctccccatgaccgtggccgccatgggcgtgccgcccctcccgctgttcatcttcagcctcaaggacaccctgaagcgccgctcctggcccctgaacgagggggtcatggccgtgggcctcgtgagcatcctggcgtccagcctgctccggaacgacgtccccatggccggccccctggtggccgggggcctgctcatcgcctgctacgtgatcacggggacctccgccgacctgaccgtcgagaaggcggccgacgtgacctgggaggaggaggccgagcagacgggcgtgagccacaacctgatgatcaccgtcgacgacgacgggaccatgcgcatcaaggacgacgagaccgagaacatcctcaccgtgctgctgaagacggccctcctgatcgtgtccggcatcttcccgtacagcatccccgccaccctgctcgtctggcacacctggcagaagcagacccagcggtccggcgtgctgtgggacgtgcccagcccgcccgagacgcagaaggcggagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggcctccgtgaagaaggacctgatcagctacggcgggggctggcggctctccgcccagtggcagaagggggaggaggtgcaggtcatcgcggtggagcccggcaagaaccccaagaacttccagaccatgcccggcaccttccagaccacgaccggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagacgaacgccgagccggacggccccacccccgagctggaggaggagatgttcaagaagcggaacctcaccatcatggacctgcaccccgggagcggcaagacccgcaagtacctgccggcgatcgtgcgggaggccatcaagcgccggctccgcacgctgatcctggcccccacccgggtggtcgccgccgagatggaggaggcgctcaaggggctgcccatccgctaccagaccaccgccacgaagtccgagcacaccggccgggagatcgtggacctgatgtgccacgccaccttcaccatgcgcctcctgagccccgtgcgggtcccgaactacaacctgatcatcatggacgaggcccacttcacggaccccgcctccatcgcggcccgcgggtacatcagcacccgggtgggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtccccagcatcaaggccggcaacgacatcgccaactgcctccggaagaacgggaagaaggtgatccagctgtcccgcaagaccttcgacacggagtaccagaagaccaagctgaacgactgggacttcgtggtcaccaccgacatcagcgagatgggcgccaacttcaagacggaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggcgcgagttcgacctctacaagaagtccggcatcacggaggtggaccggaccgaggcgaaggaggggctgaagcgcggcgagatcacccaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccgcacgatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacccacgagatgtactggatcagcaacggcaccgggaacatcgtcgcctccgtgaacatggtgagccggctcctgctgaaccgcttcacgatgacccaccggcgcccgaccatcgagaaggacgtcgacctcggcgcgggcacccggcacgtgaacgccgagcccgagacgcccaacatggacgtgatcggggagcgcatcaagcggatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgcgtgttcaaggagaaggtggacacccggaccccgcgccccatgcccggcacccggcgcgtcatgggcatcacggccgagtggctctggcggaccctggggcgcaacaagaagccccggctgtgcacccgcgaggagttcaccaagaaggtgcgcacgaacgccgccatgggcgcggtgttcaccgaggagaaccagtgggacagcgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccggcggggccatgtacgccgacgacaccgcggggtgggacacccgcatcacggaggacgacctgcacaacgaggagaagatcacccagcagatggaccccgagcaccggcagctcgccaacgccatcttcaagctgacctaccagaacaaggtggtgaaggtccagcgccccacccccaccgggacggtgatggacatcatcagccggaaggaccagcgcggctccggccaggtgggcacctacgggctgaacaccttcaccaacatggaggcccagctcatccggcagatggagggcgagggggtcctgagcaaggccgacctggagaacccgcacctccccgagaagaagatcacgcagtggctggagaccaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagccgagcaagggctggcacgactggcagcaggtccccttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgccggtccactgggtgcccacctcccggacgacctggagcatccacgcccaccaccagtggatgaccaccgaggacatgctgacggtgtggaaccgcgtctggatcgaggacaacccctggatggaggacaagacccccgtgaccacctgggagaacgtgccgtacctcgggaagcgggaggaccagtggtgcggctccctgatcgggctgacgagccgcgccacctgggcgcagaacatcagcaccgccatccagcaggtccggtccctcatcggcaacgaggagttcctggactacatgcccagcatgaagcgcttccggaaggaggaggagtccgagggggccatctggtga

SEQ ID NO: 10250 - RNA, 9873 nt, synthetic construct
  misc_feature 1..9873: note = derived and/or modified CDS sequence (opt1) from DENV-3__FJ639787__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggctgagcgccgagggcgcctggcgccaggtggagaaggtcgagacgtgggccctccgccacccggggttcaccatcctggcgctgttcctcgcccactacatcggcaccagcctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccgtgctcccggaggagcaggaccagaactacgtctgcaagcacacctacgtggaccgggggtggggcaacgggtgcggcctgttcgggaagggctccctggtgacctgcgccaagttccagtgcctcgagcccatcgagggcaaggtcgtgcagtacgagaacctgaagtacaccgtgatcatcacggtccacaccggggaccagcaccaggtgggcaacgagacccagggggtcaccgccgagatcacgccccaggccagcaccaccgaggcgatcctgcccgagtacggcaccctcgggctggagtgctccccgcgcaccggcctggacttcaacgagatgatcctcctgacgatgaagaacaaggcctggatggtgcaccggcagtggttcttcgacctgcccctcccctggaccagcggcgccaccaccgagacgcccacctggaaccgcaaggagctgctggtgaccttcaagaacgcccacgccaagaagcaggaggtcgtggtgctcgggtcccaggagggcgcgatgcacaccgccctgacgggggccaccgagatccagaacagcggcgggacctccatcttcgccggccacctgaagtgccggctcaagatggacaagctggagctgaagggcatgagctacgccatgtgcaccaacacgttcgtcctcaagaaggaggtgtccgagacccagcacgggaccatcctgatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctcggcgacaccgcctgggacttcgggtccgtgggcggggtcctgaacagcctgggcaagatggtgcaccagatcttcgggtccgcgtacacggccctcttcagcggcgtgtcctgggtcatgaagatcggcatcggggtgctgctgacctggatcggcctcaacagcaagaacacctccatgagcttctcctgcatcgccatcgggatcatcaccctgtacctgggcgccgtggtccaggccgacatggggtgcgtgatcaactggaagggcaaggagctcaagtgcggcagcgggatcttcgtgacgaacgaggtccacacctggaccgagcagtacaagttccaggcggactcccccaagcgcctggccaccgccatcgccggcgcctgggagaacggggtgtgcggcatccgcagcacgacccggatggagaacctgctctggaagcagatcgcgaacgagctgaactacatcctgtgggagaacaacatcaagctcaccgtggtcgtgggggacaccatcggcgtgctggagcagggcaagcgcacgctgacgccccagccgatggagctcaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctgaagctgcgcgaggtgtacacccagctctgcgaccaccggctgatgagcgccgccgtgaaggacgagcgcgccgtccacgccgacatgggctactggatcgagagccagaagaacgggtcctggaagctggagaaggcgagcctcatcgaggtgaagacgtgcacctggccgaagtcccacaccctgtggagcaacggcgtgctggagtccgacatgatcatccccaagagcctcgccgggcccatctcccagcacaactaccggccgggctaccacacccagacggccgggccctggcacctgggcaagctggagctcgacttcaactactgcgagggcaccaccgtcgtgatcaccgagaactgcgggacgcgcggccccagcctgcggaccaccaccgtgtccgggaagctgatccacgagtggtgctgccgcagctgcacgctgccgcccctgcggtacatgggcgaggacgggtgctggtacggcatggagatccgccccatctccgagaaggaggagaacatggtcaagagcctggtgtccgccggcagcggggaggtggacaacttcaccatgggcgtcctctgcctggccatcctgttcgaggaggtgatgcgggggaagttcggcaagaagcacatgatcgcgggggtgttcttcaccttcgtcctcctgctgtccggccagatcacctggcgcgacatggcccacacgctcatcatgatcggcagcaacgcctccgaccggatggggatgggcgtgacctacctggccctgatcgccaccttcaagatccagcccttcctcgcgctggggttcttcctgcgcaagctcaccagccgggagaacctgctgctcggcgtgggcctggccatggccacgaccctgcagctccccgaggacatcgagcagatggccaacgggatcgcgctgggcctgatggccctcaagctgatcacccagttcgagacctaccagctgtggacggccctcatcagcctgacctgctccaacaccatcttcaccctgacggtcgcctggcgcaccgccaccctcatcctggcgggggtgagcctgctccccgtctgccagtccagctccatgcggaagaccgactggctgcccatgacggtggccgccatgggcgtgccgcccctccccctgttcatcttcagcctgaaggacaccctgaagcgccgctcctggcccctcaacgagggggtcatggccgtgggcctggtgagcatcctggcctccagcctcctgcggaacgacgtccccatggcgggccccctggtggccgggggcctcctgatcgcctgctacgtgatcaccgggacctccgccgacctgacggtcgagaaggccgcggacgtgacctgggaggaggaggccgagcagaccggcgtgagccacaacctcatgatcaccgtcgacgacgacgggaccatgcgcatcaaggacgacgagacggagaacatcctgaccgtgctgctcaagaccgccctgctgatcgtgtccggcatcttcccgtacagcatccccgccaccctcctggtctggcacacgtggcagaagcagacccagcggtccggcgtgctgtgggacgtgccctccccgcccgagacccagaaggccgagctcgaggagggggtctaccgcatcaagcagcagggcatcttcgggaagacccaggtgggcgtgggggtccagaaggagggcgtgttccacacgatgtggcacgtgacccggggcgcggtcctgacctacaacgggaagcgcctggagcccaactgggcctccgtgaagaaggacctcatcagctacggcgggggctggcggctgtccgcccagtggcagaagggggaggaggtgcaggtcatcgccgtggagcccggcaagaaccccaagaacttccagaccatgccgggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctcgaggaggagatgttcaagaagcggaacctgacgatcatggacctgcaccccgggagcggcaagacccgcaagtacctcccggccatcgtgcgggaggcgatcaagcgccggctgcgcaccctgatcctcgcccccacccgggtggtcgccgccgagatggaggaggccctgaaggggctgcccatccgctaccagacgaccgcgaccaagtccgagcacaccggccgggagatcgtggacctcatgtgccacgccacgttcaccatgcgcctgctgagccccgtgcgggtcccgaactacaacctcatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctgcggaagaacgggaagaaggtgatccagctgtcccgcaagaccttcgacaccgagtaccagaagaccaagctcaacgactgggacttcgtggtcacgaccgacatcagcgagatgggcgccaacttcaaggccgaccgggtgatcgacccgcgccggtgcctgaagcccgtgatcctgaccgacggccccgagcgcgtcatcctcgccgggcccatgccggtgaccgcggcctccgccgcccagcggcgcggccgggtggggcgcaacccccagaaggagaacgaccagtacatcttcaccggccagcccctgaacaacgacgaggaccacgcccactggacggaggcgaagatgctgctcgacaacatcaacacccccgaggggatcatcccggccctgttcgagcccgagcgggagaagtccgccgccatcgacggcgagtaccgcctgaagggcgagtcccggaagaccttcgtcgagctcatgcgccgcggggacctgcccgtgtggctggcgcacaaggtcgccagcgagggcatcaagtacaccgaccgcaagtggtgcttcgacgggcagcggaacaaccagatcctcgaggagaacatggacgtggagatctggacgaaggagggcgagaagaagaagctgcgcccccggtggctggacgcccgcacctactccgacccgctcgccctgaaggagttcaaggacttcgccgcgggccgcaagagcatcgccctggacctcgtgaccgagatcgggcgggtccccacccacctggcccaccgcacgcggaacgccctggacaacctcgtgatgctgcacacctccgagcacggcgggaaggcctaccgccacgcggtggaggagctgcccgagaccatggagaccctcctgctgctcggcctgatgatcctgctcaccggcggggccatgctgttcctgatcagcgggaaggggatcggcaagaccagcatcgggctcatctgcgtcatcgcctccagcggcatgctgtggatggccgagatcccgctgcagtggatcgcctccgcgatcgtgctcgagttcttcatgatggtgctgctgatccccgagcccgagaagcagcggacgccccaggacaaccagctcgcctacgtcgtgatcgggatcctgaccctggccgccacgatcgccgcgaacgagatgggcctcctggagaccaccaagcgcgacctgggcatgagcaaggagccgggggtggtctcccccaccagctacctcgacgtggacctgcaccccgcctccgcctggacgctgtacgccgtggcgaccaccgtcatcacccccatgctccggcacacgatcgagaacagcaccgccaacgtgtccctggccgccatcgccaaccaggcggtggtcctgatgggcctcgacaaggggtggccgatcagcaagatggacctgggcgtgcccctgctcgccctggggtgctactcccaggtgaaccccctgaccctcaccgccgccgtcctgctgctcatcacgcactacgccatcatcggccccggcctgcaggcgaaggccacccgcgaggcccagaagcggaccgccgccgggatcatgaagaacccgaccgtggacggcatcatgacgatcgacctggaccccgtgatctacgacagcaagttcgagaagcagctcgggcaggtcatgctgctggtgctctgcgcggtgcagctgctgctcatgcgcacctcctgggccctgtgcgaggccctgaccctcgccaccggccccatcacgaccctgtgggagggcagccccgggaagttctggaacaccaccatcgcggtctccatggccaacatcttccggggcagctacctggccggggccggcctcgccttctccatcatgaagtccgtggggaccggcaagcgcggcacggggtcccagggcgagaccctgggggagaagtggaagaagaagctgaaccagctcagccggaaggagttcgacctgtacaagaagtccggcatcaccgaggtggaccgcaccgaggcgaaggaggggctgaagcggggcgagatcacgcaccacgccgtctcccgcggcagcgccaagctccagtggttcgtggagcggaacatggtgatcccggaggggcgcgtcatcgacctgggctgcgggcggggcgggtggtcctactactgcgccggcctgaagaaggtgaccgaggtgcgcggctacaccaagggcgggcccgggcacgaggagcccgtccccatgagcacctacggctggaacatcgtgaagctcatgtccgggaaggacgtgttctacctgccgcccgagaagtgcgacacgctgctgtgcgacatcggcgagagctcccccagccccaccgtcgaggagtcccggaccatccgcgtgctcaagatggtggagccgtggctgaagaacaaccagttctgcatcaaggtcctgaacccctacatgcccaccgtgatcgagcacctcgagcgcctgcagcggaagcacggcgggatgctggtgcgcaaccccctcagccggaactccacgcacgagatgtactggatcagcaacggcaccgggaacatcgtcgcctccgtgaacatggtgagccgcctgctgctcaaccggttcaccatgacccaccgccggccgacgatcgagaaggacgtcgacctgggcgcgggcacccgccacgtgaacgccgagcccgagacccccaacatggacgtgatcggggagcggatcaagcgcatcaaggaggagcacaactccacctggcactacgacgacgagaacccgtacaagacgtgggcctaccacggcagctacgaggtcaaggccaccgggtccgccagctccatgatcaacggcgtggtcaagctgctcaccaagccctgggacgtggtgcccatggtcacccagatggcgatgacggacaccacccccttcgggcagcagcgggtgttcaaggagaaggtggacacccgcacgccgcggagcatgcccggcacccgccgggtcatgggcatcaccgccgagtggctgtggcgcaccctggggcggaacaagaagccccgcctctgcacgcgggaggagttcaccaagaaggtgcgcaccaacgccgccatgggcgcggtgttcaccgaggagaaccagtgggacagcgccaaggccgccgtcgaggacgaggacttctggaagctggtggaccgcgagcgggagctgcacaagctcgggaagtgcggctcctgcgtgtacaacatgatggggaagcgcgagaagaagctgggcgagttcggcaaggccaaggggagccgggcgatctggtacatgtggctgggcgcccgctacctcgagttcgaggccctggggttcctgaacgaggaccactggttctcccgggagaacagctactccggcgtcgagggggagggcctccacaagctgggctacatcctgcgcgacatcagcaagatccccgggggcgccatgtacgccgacgacacggcggggtgggacacccggatcaccgaggacgacctccacaacgaggagaagatcacccagcagatggacccggagcaccgccagctggccaacgccatcttcaagctgacctaccagaacaaggtggtgaaggtccagcggcccacgcccaccggcaccgtgatggacatcatctcccgcaaggaccagcggggcagcggccaggtgggcacctacgggctcaacacgttcaccaacatggaggcccagctgatccgccagatggagggcgagggggtcctgtccaaggccgacctcgagaacccccacctcccggagaagaagatcacccagtggctggagaccaagggcgtggagcggctcaagcgcatggcgatcagcggcgacgactgcgtggtcaagcccatcgacgaccggttcgccaacgccctgctggccctcaacgacatggggaaggtgcgcaaggacatcccccagtggcagccctccaagggctggcacgactggcagcaggtcccgttctgcagccaccacttccacgagctgatcatgaaggacgggcggaagctggtcgtgccctgccgcccccaggacgagctcatcggccgggcccgcatctcccagggggcgggctggagcctgcgggagacggcctgcctgggcaaggcctacgcccagatgtggtccctcatgtacttccaccgccgcgacctgcggctggcgagcaacgccatctgctccgccgtgcccgtccactgggtgccgaccagccgcaccacctggtccatccacgcccaccaccagtggatgacgaccgaggacatgctcaccgtgtggaaccgggtctggatcgaggacaacccctggatggaggacaagacccccgtgacgacctgggagaacgtgccctacctggggaagcgcgaggaccagtggtgcggcagcctgatcgggctcaccagccgggccacctgggcgcagaacatcccgacggccatccagcaggtccgctccctgatcggcaacgaggagttcctggactacatgcccagcatgaagcggttccgcaaggaggaggagtccgagggggccatctggtga

SEQ ID NO: 10251 - RNA, 9873 nt, synthetic construct
  misc_feature 1..9873: note = derived and/or modified CDS sequence (opt1) from DENV-3__FJ639790__SS-prME
  source 1..9873: mol_type = other RNA
accagcctgtgcctcatgatgatcctgcccgccgccctggcgttccacctcacctcccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcctgaccttcgtcctcctgctgtccggccagatcacctggcgcgacatggcccacaccctcatcatgatcggcagcaacgcctccgaccggatggggatgggcgtgacgtacctggccctgatcgccaccttcaagatccagcccttcctcgcgctggggttcttcctgcgcaagctcaccagccgggagaacctgctgctcggcgtgggcctggccatggccaccacgctgcagctccccgaggacatcgagcagatggccaacgggatcgcgctgggcctgatggccctcaagctgatcacccagttcgagacctaccagctgtggaccgccctcatcagcctgacgtgctccaacaccatcttcaccctgaccgtcgcctggcgcacggccaccctcatcctggcgggggtgagcctgctcccggtctgccagtccagctccatgcggaagaccgactggctgcccatgaccgtggccgccatgggcgtgccgcccctgcccctgttcatcttcaacctgaaggacacgctgaagcgccgcagctggcccctcaacgagggggtcatggccgtgggcctggtgtccatcctggccagctccctcctgcggaacgacgtccccatggcgggccccctggtggccgggggcctcctgatcgcctgctacgtgatcaccgggaccagcgccgacctgaccgtcgagaaggccgcggacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgccctgctgatcgtgagcggcatcttcccgtactccatccccgccaccctcctggtctggcacacctggcagaagcagacgcagcggagcggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgcggtcctgacctacaacgggaagcgcctggagcccaactgggccagcgtgaagaaggacctcatctcctacggcgggggctggcggctgagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctcgaggaggagatgttcaagaagcggaacctgaccatcatggacctgcaccccgggtccggcaagacgcgcaagtacctcccggccatcgtgcgggaggcgatcaagcgccggctgcgcaccctgatcctcgcccccacccgggtggtcgccgccgagatggaggaggccctgaaggggctgcccatccgctaccagaccacggcgaccaagagcgagcacaccggccgggagatcgtggacctcatgtgccacgccaccttcacgatgcgcctgctgtcccccgtgcgggtcccgaactacaacctcatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctgcggaagaacgggaagaaggtgatccagctgagccgcaagacgttcgacaccgagtaccagaagaccaagctcaacgactgggacttcgtggtcaccacggacatctccgagatgggcgccaacttcaaggccgaccgggtgatcgacccgcgccggtgcctgaagcccgtgatcctgaccgacggccccgagcgcgtcatcctcgccgggcccatgccggtgaccgcggccagcgccgcccagcggcgcggccgggtggggcgcaacccccagaaggagaacgaccagtacatcttcaccggccagcccctgaacaacgacgaggaccacgcccactggaccgaggcgaagatgctgctcgacaacatcaacacgcccgaggggatcatcccggccctgttcgagcccgagcgggagaagtccgccgccatcgacggcgagtaccgcctgaagggcgagagccggaagaccttcgtcgagctcatgcgccgcggggacctgcccgtgtggctggcgcacaaggtcgcctccgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacgtacagcgacccgctcgccctgaaggagttcaaggacttcgccgcgggccgcaagtccatcgccctggacctcgtgaccgagatcgggcgggtccccacccacctggcccaccgcacccggaacgccctggacaacctcgtgatgctgcacacgagcgagcacggcgggaaggcctaccgccacgcggtggaggagctgcccgagaccatggagaccctcctgctgctcggcctgatgatcctgctcaccgggggcgccatgctgttcctgatctccggcaaggggatcggcaagacgagcatcgggctcatctgcgtcatcgccagctccggcatgctgtggatggccgagatcccgctgcagtggatcgccagcgcgatcgtgctcgagttcttcatgatggtgctgctgatccccgagcccgagaagcagcggacgccccaggacaaccagctcgcctacgtcgtgatcgggatcctgaccctggccgccatcatcgccgcgaacgagatgggcctcctggagaccacgaagcgcgacctgggcatgtccaaggagccgggggtggtcagccccacctcctacctcgacgtggacctgcaccccgccagcgcctggaccctgtacgccgtggcgaccacggtcatcacccccatgctccggcacaccatcgagaactccaccgccaacgtgagcctggccgccatcgccaaccaggcggtggtcctgatgggcctcgacaaggggtggccgatctccaagatggacctgggcgtgcccctgctcgccctggggtgctacagccaggtgaaccccctgacgctcaccgccgccgtcctgctgctcatcacccactacgccatcatcggccccggcctgcaggcgaaggccacccgcgaggcccagaagcggacggccgccgggatcatgaagaacccgaccgtggacggcatcatgaccatcgacctggaccccgtgatctacgactccaagttcgagaagcagctcgggcaggtcatgctgctggtgctctgcgcggtgcagctgctgctcatgcgcaccagctgggccctgtgcgaggccctgacgctcgccaccggccccatcaccaccctgtgggagggctcccccgggaagttctggaacacgaccatcgcggtcagcatggccaacatcttccggggctcctacctggccggggccggcctcgccttcagcatcatgaagtccgtggggaccggcaagcgcggcaccgggagccagggcgagaccctgggggagaagtggaagaagaagctgaaccagctctcccggaaggagttcgacctgtacaagaagtccggcatcacggaggtggaccgcaccgaggcgaaggaggggctgaagcggggcgagatcacccaccacgccgtcagccgcggctccgccaagctccagtggttcgtggagcggaacatggtgatcccggaggggcgcgtcatcgacctgggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctcatgagcgggaaggacgtgttctacctgccgcccgagaagtgcgacaccctgctgtgcgacatcggcgagtccagcccctcccccaccgtcgaggagagccggacgatccgcgtgctcaagatggtggagccgtggctgaagaacaaccagttctgcatcaaggtcctgaacccctacatgcccaccgtgatcgagcacctcgagcgcctgcagcggaagcacggcgggatgctggtgcgcaaccccctctcccggaacagcacccacgagatgtactggatctccaacggcaccgggaacatcgtcgccagcgtgaacatggtgtcccgcctgctgctcaaccggttcacgatgacccaccgccggccgaccatcgagaaggacgtcgacctgggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctcacgaagccctgggacgtggtgcccatggtcacccagatggcgatgaccgacaccacgcccttcgggcagcagcgggtgttcaaggagaaggtggacacccgcaccccgcggtccatgcccggcacccgccgggtcatgggcatcacggccgagtggctgtggcgcaccctggggcggaacaagaagccccgcctctgcacccgggaggagttcaccaagaaggtgcgcacgaacgccgccatgggcgcggtgttcaccgaggagaaccagtgggacagcgccaaggccgccgtcgaggacgaggacttctggaagctggtggaccgcgagcgggagctgcacaagctcgggaagtgcggcagctgcgtgtacaacatgatggggaagcgcgagaagaagctgggcgagttcggcaaggccaaggggtcccgggcgatctggtacatgtggctgggcgcccgctacctcgagttcgaggccctggggttcctgaacgaggaccactggttcagccgggagaactcctacagcggcgtcgagggggagggcctccacaagctgggctacatcctgcgcgacatctccaagatccccgggggcgccatgtacgccgacgacaccgcggggtgggacacccggatcacggaggacgacctccacaacgaggagaagatcacccagcagatggacccggagcaccgccagctggccaacgccatcttcaagctgacctaccagaacaaggtggtgaaggtccagcggcccacccccgccggcaccgtgatggacatcatcagccgcaaggaccagcggggctccggccaggtgggcacgtacgggctcaacaccttcaccaacatggaggcccagctgatccgccagatggagggcgagggggtcctgagcaaggcggacctcgagaacccccacctcccggagaagaagatcacccagtggctggagacgaagggcgtggagcggctcaagcgcatggccatctccggcgacgactgcgtggtcaagcccatcgacgaccggttcgccaacgccctgctggccctcaacgacatggggaaggtgcgcaaggacatcccccagtggcagcccagcaagggctggcacgactggcagcaggtcccgttctgctcccaccacttccacgagctgatcatgaaggacgggcggaagctggtcgtgccctgccgcccccaggacgagctcatcggccgggcgcgcatcagccagggggccggctggtccctgcgggagaccgcctgcctgggcaaggcctacgcgcagatgtggagcctcatgtacttccaccgccgcgacctgcggctggcctccaacgccatctgcagcgccgtgcccgtccactgggtgccgacctcccgcaccacgtggagcatccacgcccaccaccagtggatgaccaccgaggacatgctcaccgtgtggaaccgggtctggatcgaggacaacccctggatggaggacaagacgcccgtgaccacctgggagaacgtgccctacctggggaagcgcgaggaccagtggtgcggctccctgatcgggctcaccagccgggcgacgtgggcccagaacatcccgaccgccatccagcaggtccgcagcctgatcggcaacgaggagttcctggactacatgccctccatgaagcggttccgcaaggaggaggagagcgagggggccatctggtga

SEQ ID NO: 10252 - RNA, 9873 nt, synthetic construct
  misc_feature 1..9873: note = derived and/or modified CDS sequence (opt1) from DENV-3__FJ639791__SS-prME
  source 1..9873: mol_type = other RNA
accagcctctgcctcatgatgatcctgcccgccgccctggcgttccacctcaccagccgggacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccgtcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaagatccccttcagcaccgaggacgggcagggcaaggcgcacaacggccgcctgatcacggccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtgaagtccctggtgtccgccggcagcggggaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagatctaccagctgtggaccgccctgatcagcctgacctgctccaacacgatcttcaccctgaccgtggcctggcgcaccgccacgctgatcctcgcgggggtcagcctgctgccggtgtgccagtccagctccatgcggaagaccgactggctccccatgaccgtggccgccatgggcgtgccgcccctcccgctgttcatcttcaacctcaaggacaccctgaagcgccgcagctggcccctgaacgagggggtgatggccgtgggcctcgtctccatcctggccagctccctgctccggaacgacgtgcccatggcgggccccctggtggccgggggcctgctcatcgcctgctacgtcatcacggggaccagcgccgacctgaccgtggagaaggccgcggacgtgacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcatcttcccgtactccatccccgccaccctgctcgtgtggcacacctggcagaagcagacccagcggagcggcgtgctgtgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgcggtgctcacgtacaacgggaagcgcctggagcccaactgggccagcgtgaagaaggacctgatctcctacggcgggggctggcggctcagcgcccagtggcagaagggggaggaggtccaggtgatcgccgtggagcccggcaagaaccccaagaacttccagaccatgcccggcaccttccagaccacgaccggggagatcggcgcgatcgccctggacttcaagcccgggacctccggcagccccatcatcaaccgcgagggcaaggtcgtggggctgtacggcaacggggtggtcaccaagaacggcgggtacgtgagcggcatcgcccagacgaacgccgagccggacggccccacccccgagctggaggaggagatgttcaagaagcggaacctcaccatcatggacctgcaccccgggtccggcaagacccgcaagtacctgccggccatcgtgcgggaggcgatcaagcgccggctccgcacgctgatcctggcccccacccgggtcgtggccgccgagatggaggaggccctcaaggggctgcccatccgctaccagaccaccgcgaccaagagcgagcacacgggccgggagatcgtggacctgatgtgccacgccaccttcaccatgcgcctcctgtcccccgtccgggtgccgaactacaacctgatcatcatggacgaggcccacttcacggaccccgccagcatcgccgcgcgcgggtacatctccacccgggtgggcatgggcgaggccgccgccatcttcatgaccgcgacgccgcccgggacggccgacgccttcccgcagagcaacgcccccatccaggacgaggagcgcgacatccccgagcgctcctggaacagcggcaacgagtggatcaccgacttcgccgggaagaccgtctggttcgtgccctccatcaaggcgggcaacgacatcgccaactgcctccggaagaacgggaagaaggtgatccagctgagccgcaagaccttcgacacggagtaccagaagaccaagctgaacgactgggacttcgtcgtgaccaccgacatctccgagatgggcgccaacttcaaggccgaccgggtgatcgacccgcgccggtgcctcaagcccgtcatcctgacggacggccccgagcgcgtgatcctggccgggcccatgccggtgaccgcggccagcgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagacgttcgtggagctgatgcgccgcggggacctccccgtctggctggcgcacaaggtggcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggccctcaaggagttcaaggacttcgccgcgggccgcaagtccatcgccctggacctggtcacggagatcgggcgggtgcccacccacctcgcccaccgcacccggaacgccctggacaacctggtgatgctccacaccagcgagcacggcgggaaggcctaccgccacgcggtcgaggagctgcccgagacgatggagaccctgctcctgctgggcctcatgatcctgctgaccgggggcgccatgctgttcctgatctccggcaaggggatcggcaagaccagcatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgtcccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatcagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtgatcgagcacctggagcgcctccagcggaagcacggcgggatgctggtccgcaaccccctgtcccggaacagcacccacgagatgtactggatctccaacggcagcgggaacatcgtggcctccgtgaacatggtcagccgcctcctgctgaaccggttcaccatgacccaccgccggccgacgatcgagaaggacgtggacctcggcgcgggcacccgccacgtgaacgccgagcccgagacccccaacatggacgtcatcggggagcggatcaagcgcatcaaggaggagcacaactccacctggcactacgacgacgagaacccgtacaagacgtgggcctaccacggcagctacgaggtgaaggccaccgggtccgccagctccatgatcaacggcgtcgtgaagctgctgaccaagccctgggacgtggtccccatggtgacccagatggcgatgacggacaccacccccttcgggcagcagcgggtgttcaaggagaaggtcgacacccgcacgccgcggagcatgcccggcacccgccgggtgatgggcatcaccgccgagtggctctggcgcaccctggggcggaacaagaagccccgcctgtgcacgcgggaggagttcaccaagaaggtgcgcaccaacgccgccatgggcgcggtcttcaccgaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacgtaccagaacaaggtggtcaaggtgcagcggcccacccccaccggcaccgtgatggacatcatctcccgcaaggaccagcggggcagcgggcaggtcggcacctacgggctgaacacgttcaccaacatggaggcccagctcatccgccagatggagggcgagggggtgctgtccaaggccgacctggagaacccccacctcccggagaagaagatcacccagtggctggagaccaagggcgtggagcggctgaagcgcatggcgatcagcggcgacgactgcgtcgtgaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcccgcatctcccagggggcgggctggagcctccgggagacggcctgcctgggcaaggcctacgcccagatgtggtccctgatgtacttccaccgccgcgacctccggctggcgagcaacgccatctgctccgccgtccccgtgcactgggtgccgaccagccgcaccacctggtccatccacgcccaccaccagtggatgacgaccgaggacatgctgaccgtctggaaccgggtgtggatcgaggacaacccctggatggaggacaagacccccgtgacgacctgggagaacgtcccctacctcgggaagcgcgaggaccagtggtgcggcagcctgatcgggctgaccagccgggccacctgggcgcagaacatcccgacggccatccagcaggtccgctccctcatcggcaacgaggagttcctggactacatgcccagcatgaagcggttccgcaaggaggaggagtccgagggggccatctggtga

SEQ ID NO: 10253 - RNA, 9873 nt, synthetic construct
  misc_feature 1..9873: note = derived and/or modified CDS sequence (opt1) from DENV-3__FJ639792__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacccacaacgggaagcgcctggagcccaactgggcctccgtgaagcgggacctgatcagctacggcgggggctggcgcctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgggagggcaaggtggtcgggctgtacggcaacggggtggtgacgaagaacggcgggtacgtctccggcatcgcccagaccaacgccgagccggacggccccacccccgagctggaggaggagatgttcaagaagcgcaacctcaccatcatggacctgcaccccgggagcggcaagacgcggaagtacctgccggccatcgtgcgcgaggcgatcaagcggcgcctccggaccctgatcctggcccccacccgcgtggtcgccgccgagatggaggaggccctcaaggggctgcccatccggtaccagaccacggcgaccaagtccgagcacaccggccgcgagatcgtggacctgatgtgccacgccaccttcacgatgcggctcctgagccccgtgcgcgtcccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtgtggttcgtccccagcatcaaggcgggcaacgacatcgccaactgcctccgcaagaacgggaagaaggtgatccagctgtcccggaagacgttcgacaccgagtaccagaagaccaagctgaacgactgggacttcgtggtcaccacggacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgtacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggacttcgccgcgggccgcaagagcatcgccctggacctggtgaccgagatcgggcgcgtccccacccacctcgcccaccggacccgcaacgccctggacaacctggtgatgctccacacgtccgagcacggcgggaaggcctaccggcacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagaccacgaagcgggacctgggcatgagcaaggagccgggggtggtctcccccaccagctacctggacgtggacctccaccccgcctccgcctggaccctgtacgccgtggcgaccacggtcatcacccccatgctgcgccacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgggaggcccagaagcgcacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcggacctcctgggccctctgcgaggccctgacgctggccaccggccccatcaccaccctctgggagggcagccccgggaagttctggaacacgaccatcgcggtctccatggccaacatcttccgcggcagctacctggccggggccggcctggccttctccatcatgaagtccgtggggaccggcaagcggggcaccgggtcccagggcgagaccctcggggagaagtggaagaagaagctgaaccagctgagccgcaaggagttcgacctctacaagaagtccggcatcacggaggtggaccggaccgaggcgaaggaggggctgaagcgcggcgagatcacccaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccgcacgatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacccacgagatgtactggatcagcaacggcaccgggaacatcgtcgcctccgtgaacatggtgagccggctcctgctgaaccgcttcacgatgacccaccggcgcccgaccatcgagaaggacgtcgacctcggcgcgggcacccggcacgtgaacgccgagcccgagacgcccaacatggacgtgatcggggagcgcatcaagcggatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgcgtgttcaaggagaaggtggacacccggaccccgcgcagcatgcccggcacccggcgcgtcatgggcatcacggccgagtggctctggcggaccctggggcgcaacaagaagccccggctgtgcacccgcgaggagttcaccaagaaggtgcgcacgaacgccgccatgggcgcggtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaccggcacggtgatggacatcatctcccggaaggaccagcgcggcagcggccaggtgggcacctacgggctgaacaccttcaccaacatggaggcccagctcatccggcagatggagggcgagggggtcctgtccaaggccgacctggagaacccccacctcccggagaagaagatcacgcagtggctggagaccaagggcgtggagcgcctgaagcggatggcgatcagcggcgacgactgcgtggtcaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggcgggctggagcctccgcgagaccgcctgcctgggcaaggcctacgcccagatgtggtccctgatgtacttccaccgccgggacctccgcctggcgagcaacgccatctgctccgccgtgcccgtccactgggtgccgaccagccggacgacctggtccatccacgcccaccaccagtggatgaccaccgaggacatgctgacggtgtggaaccgcgtctggatcgaggacaacccctggatggaggacaagacccccgtgaccacctgggagaacgtgccctacctcgggaagcgggaggaccagtggtgcggcagcctgatcgggctgacgagccgcgccacctgggcgcagaacatcccgaccgccatccagcaggtccggtccctcatcggcaacgaggagttcctggactacatgcccagcatgaagcgcttccggaaggaggaggagtccgagggggccatctggtga

SEQ ID NO: 10254 - RNA, 9873 nt, synthetic construct
  misc_feature 1..9873: note = derived and/or modified CDS sequence (opt1) from DENV-3__FJ639793__SS-prME
  source 1..9873: mol_type = other RNA
accagcctctgcctcatgatgatcctgcccgcgaccctggccttccacctcaccagccgggacggggagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggagcgtcgccctcgcgccccacgtgggcatggggctggacacccgcacccagacgtggatgagcgcggagggcgcctggcgccaggtggagaaggtcgagacctgggccctgcgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcggtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggccatcctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcccacaacggccgcctgatcaccgcgaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggccaccgcgcggggcgcccgccggatggccatcctgggcgacacggcctgggacttcgggtccgtgggcggggtcctcaacagcctgggcaagatggtgcaccagatcttcgggtccgcctacaccgcgctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggccgactcccccaagcgcctcgcgacggccatcgccggcgcctgggagaacggggtgtgcggcatccgcagcaccacccggatggagaacctgctgtggaagcagatcgccaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcgaagatcgtcaccgccgagacgcagaacagctccttcatcatcgacggccccaacacccccgagtgccccagcgcctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccacctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgccggggtgttcttcaccttcgtcctgctcctgtccggccagatcacgtggcgcgacatggcgcacaccctgatcatgatcggcagcaacgcctccgaccggatggggatgggcgtgacctacctcgccctgatcgccaccttcaagatccagcccttcctggccctcgggttcttcctgcgcaagctgacgagccgggagaacctcctgctgggcgtgggcctcgcgatggccaccaccctgcagctgcccgaggacatcgagcagatggccaacgggatcgccctcggcctgatggcgctgaagctcatcacccagttcgagacgtaccagctgtggaccgccctgatcagcctgacctgctccaacaccatcttcacgctgaccgtcgcctggcgcaccgccaccctgatcctcgccggggtgagcctgctgccggtctgccagtccagctccatgcggaagacggactggctccccatgaccgtggcggccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggccggccccctggtggccggcgggctgctcatcgcctgctacgtgatcaccgggacgtccgccgacctgaccgtcgagaaggccgccgacgtgacctgggaggaggaggcggagcagaccggggtgagccacaacctgatgatcaccgtcgacgacgacgggacgatgcgcatcaaggacgacgagaccgagaacatcctcaccgtgctgctgaagaccgccctcctgatcgtgtccggcatcttcccgtacagcatccccgccacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagacgatgcccggcaccttccagaccaccacgggggagatcggcgccatcgcgctggacttcaagcccgggaccagcggcagccccatcatcaaccgcgagggcaagatcgtggggctgtacggcaacggggtcgtgaccaagaacggcgggtacgtgtccggcatcgcccagaccaacgccgagccggacggccccacgcccgagctggaggaggagatgttcaagaagcggaacctcaccatcatggacctgcaccccgggagcggcaagacccgcaagtacctgccggccatcgtccgggaggccatcaagcgccggctccgcaccctgatcctggcgcccacgcgggtggtggccgccgagatggaggaggccctcaaggggctgcccatccgctaccagaccaccgccaccaagtccgagcacacgggccgggagatcgtcgacctgatgtgccacgcgaccttcaccatgcgcctcctgagccccgtgcgggtgccgaactacaacctgatcatcatggacgaggcccacttcaccgaccccgcctccatcgccgcccgcgggtacatcagcacgcgggtcggcatgggcgaggcggccgccatcttcatgaccgccacgccgcccgggaccgcggacgccttcccgcagtccaacgcccccatccaggacgaggagcgcgacatccccgagcgcagctggaactccggcaacgagtggatcacggacttcgccgggaagaccgtgtggttcgtgcccagcatcaaggccggcaacgacatcgcgaactgcctccggaagaacgggaagaaggtcatccagctgtcccgcaagaccttcgacaccgagtaccagaagacgaagctgaacgactgggacttcgtggtgaccaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgccgcgtccgccgcccagcggcgcggccgggtggggcgcaacccccagaaggagaacgaccagtacatcttcacgggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcccacaaggtggcgagcgagggcatcaagtacacggaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgccgccggccgcaagagcatcgcgctggacctggtgaccgagatcgggcgggtgcccacgcacctcgcccaccgcacccggaacgccctggacaacctggtcatgctccacacctccgagcacggcgggaaggcctaccgccacgccgtggaggagctgcccgagaccatggagacgctgctcctgctgggcctcatgatcctgctgaccgggggcgcgatgctgttcctgatcagcggcaaggggatcggcaagaccagcatcgggctgatctgcgtgatcgcctccagcggcatgctctggatggccgagatcccgctgcagtggatcgcctccgccatcgtcctggagttcttcatgatggtgctcctgatccccgagcccgagaagcagcggacgccccaggacaaccagctggcgtacgtggtcatcgggatcctcacgctggccgccatcatcgccgccaacgagatgggcctgctcgagaccaccaagcgcgacctgggcatgagcaaggagccgggggtggtgtcccccaccagctacctggacgtcgacctccaccccgcgtccgcctggacgctgtacgccgtggccaccaccgtgatcacccccatgctgcggcacacgatcgagaacagcaccgcgaacgtctccctcgccgccatcgccaaccaggccgtggtgctgatgggcctggacaaggggtggccgatcagcaagatggacctcggcgtccccctgctggcgctcgggtgctactcccaggtgaaccccctgaccctgaccgccgccgtgctcctgctgatcacgcactacgccatcatcggccccggcctccaggccaaggcgacccgcgaggcccagaagcggaccgccgccgggatcatgaagaacccgaccgtcgacggcatcatgacgatcgacctggaccccgtgatctacgacagcaagttcgagaagcagctgggccaggtgatgctcctggtcctgtgcgccgtgcagctcctgctgatgcgcacctcctgggcgctctgcgaggccctgaccctggccaccggccccatcacgaccctctgggagggcagccccgggaagttctggaacaccaccatcgccgtgtccatggcgaacatcttccggggcagctacctggccggggccggcctggccttctccgtcatgaagtccgtggggaccggcaagcgcggcacggggtcccagggcgagaccctcggggagaagtggaagaagaagctgaaccagctgagccggaaggagttcgacctctacaagaagtccggcatcaccgaggtggaccgcaccgaggccaaggaggggctgaagcggggcgagatcacgcaccacgcggtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacgcacgagatgtactggatcagcaacggcaccgggaacatcgtcgcctccgtgaacatggtgagccgcctcctgctgaaccggttcaccatgacccaccgccggccgacgatcgagaaggacgtcgacctcggcgccggcacccgccacgtgaacgcggagcccgagacccccaacatggacgtgatcggggagcggatcaagcgcatcaaggaggagcacaactccacctggcactacgacgacgagaacccgtacaagacgtgggcctaccacggcagctacgaggtcaaggccaccgggtccgccagctccatgatcaacggcgtggtcaagctgctgaccaagccctgggacgtggtgcccatggtcacccagatggccatgacggacaccacccccttcgggcagcagcgggtgttcaaggagaaggtggacacccgcacgccgcggagcatgcccggcacccgccgggtcatgggcatcaccgcggagtggctctggcgcaccctggggcggaacaagaagccccgcctgtgcacgcgggaggagttcaccaagaaggtgcgcaccaacgccgccatgggcgccgtgttcaccgaggagaaccagtgggacagcgcgaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacacggccgggtgggacacccggatcaccgaggacgacctgcacaacgaggagaagatcacccagcagatggacccggagcaccgccagctcgcgaacgccatcttcaagctgacctaccagaacaaggtggtgaaggtccagcggcccacgcccaccggcaccgtgatggacatcatctcccgcaaggaccagcggggcagcggccaggtgggcacctacgggctgaacacgttcaccaacatggaggcccagctcatccgccagatggagggcgagggggtcctgtccaaggccgacctggagaacccccacctcccggagaagaagatcacccagtggctggagaccaagggcgtggagcggctgaagcgcatggccatcagcggcgacgactgcgtggtcaagcccatcgacgaccggttcgcgaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggccggctggagcctccgggagacggcgtgcctgggcaaggcctacgcccagatgtggtccctgatgtacttccaccgccgcgacctccggctggccagcaacgcgatctgctccgccgtgcccgtccactgggtgccgaccagccgcaccacctggtccatccacgcccaccaccagtggatgacgaccgaggacatgctgaccgtgtggaaccgggtctggatcgaggacaacccctggatggaggacaagacccccgtgacgacctgggagaacgtgccctacctcgggaagcgcgaggaccagtggtgcggcagcctgatcgggctgaccagccgggccacctgggcccagaacatcccgacggcgatccagcaggtccgctccctcatcggcaacgaggagttcctggactacatgcccagcatgaagcggttccgcaaggaggaggagtccgagggggccatctggtga

SEQ ID NO: 10255 - RNA, 9873 nt, synthetic construct
  misc_feature 1..9873: note = derived and/or modified CDS sequence (opt1) from DENV-3__FJ639795__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcatcacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtggcctggcgcaccgccaccctgatcctcgcgggggtcagcctgctgccggtgtgccagtccagctccatgcggaagaccgactggctccccatgacggtcgccgccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggcgggccccctggtcgccgggggcctgctcatcgcctgctacgtgatcaccgggacctccgccgacctgacggtggagaaggccgcggacgtcacctgggaggaggaggccgagcagaccggcgtgagccacaacctgatgatcaccgtggacgacgacgggaccatgcgcatcaaggacgacgagacggagaacatcctcaccgtcctgctgaagaccgccctcctgatcgtgtccggcatcttcccgtacagcatccccgccaccctgctcgtgtggcacacgtggcagaagcagacccagcggtccggcgtcctgtgggacgtgcccagcccgcccgagacccagaaggccgagctggaggagggggtgtaccgcatcaagcagcagggcatcttcgggaagacccaggtcggcgtgggggtgcagaaggagggcgtcttccacacgatgtggcacgtgacccggggcgcggtgctcacctacaacgggaagcgcctggagcccaactgggcctccgtcaagaaggacctgatcagctacggcgggggctggcggctctccgcccagtggcagaagggggaggaggtccaggtgatcgccgtcgagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggccatcgtccgggaggcgatcaagcgccggctccgcaccctgatcctggcccccacccgggtggtggccgccgagatggaggaggccctcaaggggctgcccatccgctaccagacgaccgcgaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtgcccagcatcaaggcgggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtgcccacccacctcgcccaccgcacgcggaacgccctggacaacctggtcatgctccacacctccgagcacggcgggaaggcctaccgccacgcggtggaggagctgcccgagaccatggagaccctgctcctgctgggcctcatgatcctgctgaccggcggggccatgctgttcctgatcagcgggaaggggatcggcaagaccagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcggacgccccaggacaaccagctggcctacgtggtcatcgggatcctcaccctggccgccacgatcgccgcgaacgagatgggcctgctcgagaccaccaagcgcgacctgggcatgagcaaggagccgggggtggtgtcccccaccagctacctggacgtcgacctccaccccgcctccgcctggacgctgtacgccgtggcgaccaccgtgatcacccccatgctgcggcacacgatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgaccctgaccgccgccgtgctcctgctgatcacgcactacgccatcatcggccccggcctccaggcgaaggccacccgcgaggcccagaagcggaccgccgccgggatcatgaagaacccgaccgtcgacggcatcatgacgatcgacctggaccccgtgatctacgacagcaagttcgagaagcagctgggccaggtgatgctcctggtcctgtgcgcggtgcagctcctgctgatgcgcacctcctgggccctctgcgaggccctgaccctggccaccggccccatcacgaccctctgggagggcagccccgggaagttctggaacaccaccatcgcggtgtccatggccaacatcttccggggcagctacctggccggggccggcctggccttctccatcatgaagtccgtcgggaccggcaagcgcggcacggggtcccagggcgagaccctcggggagaagtggaagaagaagctgaaccagctgagccggaaggagttcgacctctacaagaagtccggcatcaccgaggtggaccgcaccgaggcgaaggaggggctgaagcggggcgagatcacgcaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcaccgaggtgcgcggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacgcacgagatgtactggatcagcaacggcaccgggaacatcgtggcctccgtcaacatggtgagccgcctcctgctgaaccggttcaccatgacccaccgccggccgacgatcgagaaggacgtggacctcggcgcgggcacccgccacgtcaacgccgagcccgagacccccaacatggacgtgatcggggagcggatcaagcgcatcaaggaggagcacaactccacctggcactacgacgacgagaacccgtacaagacgtgggcctaccacggcagctacgaggtgaaggccaccgggtccgccagctccatgatcaacggcgtcgtgaagctgctgaccaagccctgggacgtcgtgcccatggtgacccagatggcgatgacggacaccacccccttcgggcagcagcgggtcttcaaggagaaggtggacacccgcacgccgcggagcatgcccggcacccgccgggtgatgggcatcaccgccgagtggctctggcgcaccctggggcggaacaagaagccccgcctgtgcacgcgggaggagttcaccaagaaggtccgcaccaacgccgccatgggcgcggtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacacggcggggtgggacacccggatcaccgaggacgacctgcacaacgaggagaagatcacccagcagatggacccggagcaccgccagctcgccaacgccatcttcaagctgacctaccagaacaaggtcgtgaaggtgcagcggcccacgcccaccggcaccgtcatggacatcatctcccgcaaggaccagcggggcagcggccaggtgggcacctacgggctgaacacgttcaccaacatggaggcccagctcatccgccagatggagggcgagggggtgctgctgaaggccgacctcgagaacccccacctccccgagaagaagatcacccagtggctggagaccaagggcgtcgagcggctcaagcgcatggcgatctccggcgacgactgcgtggtgaagcccatcgacgaccggttcgccaacgccctgctggccctcaacgacatggggaaggtccgcaaggacatcccccagtggcagcccagcaagggctggcacgactggcagcaggtcccgttctgctcccaccacttccacgagctgatcatgaaggacgggcggaagctggtggtcccctgccgcccccaggacgagctcatcggccgggcccgcatcagccagggggcgggctggtccctgcgggagacggcctgcctgggcaaggcctacgcccagatgtggagcctcatgtacttccaccgccgcgacctgcggctggcgtccaacgccatctgcagcgccgtgcccgtgcactgggtcccgacctcccgcaccacctggagcatccacgcccaccaccagtggatgacgaccgaggacatgctcaccgtgtggaaccgggtgtggatcgaggacaacccctggatggaggacaagacccccgtcacgacctgggagaacgtgccctacctggggaagcgcgaggaccagtggtgcggctccctgatcgggctcaccagccgggccacctgggcgcagaacatcccgacggccatccagcaggtccgcagcctgatcggcaacgaggagttcctggactacatgccctccatgaagcggttccgcaaggaggaggagagcgagggggccatctggtga

SEQ ID NO: 10256 - RNA, 9873 nt, synthetic construct
  misc_feature 1..9873: note = derived and/or modified CDS sequence (opt1) from DENV-3__FJ639798__SS-prME
  source 1..9873: mol_type = other RNA
accagcctgtgcctcatgatgatcctgcccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccgtcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaagatccccttcagcaccgaggacgggcagggcaaggcgcacaacggccgcctgatcacggccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgcccacccacctcgcccaccgcacccggaacgccctggacaacctggtgatgctccacacgtccgagcacggcgggaaggcctaccgccacgcggtcgaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcggacgccccaggacaaccagctggcctacgtggtgatcgggatcctcaccctggccgccaccatcgccgcgaacgagatgggcctgctcgagacgaccaagcgcgacctgggcatgagcaaggagccgggggtcgtgtcccccaccagctacctggacgtggacctccaccccgcctccgcctggaccctgtacgccgtcgcgacgaccgtgatcacccccatgctgcggcacaccatcgagaacagcacggccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgaccctgaccgccgccgtgctcctgctgatcacccactacgccatcatcggccccggcctccaggcgaaggccacgcgcgaggcccagaagcggaccgccgccgggatcatgaagaacccgaccgtggacggcatcatgaccatcgacctggaccccgtcatctacgacagcaagttcgagaagcagctgggccaggtgatgctcctggtgctgtgcgcggtccagctcctgctgatgcgcacgtcctgggccctctgcgaggccctgaccctggccaccggccccatcaccacgctctgggagggcagccccgggaagttctggaacaccaccatcgcggtgtccatggccaacatcttccggggcagctacctggccggggccggcctggccttctccatcatgaagtccgtggggaccggcaagcgcggcaccgggtcccagggcgagacgctcggggagaagtggaagaagaagctgaaccagctgagccggcgcgagttcgacctctacaagaagtccggcatcaccgaggtcgaccggaccgaggcgaaggaggggctgaagcgcggcgagatcacccaccacgccgtgtcccggggcagcgccaagctgcagtggttcgtggagcgcaacatggtcatcccggaggggcgggtgatcgacctcggctgcgggcgcggcgggtggtcctactactgcgccggcctgaagaaggtgacggaggtccggggctacaccaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccacggtggaggagtcccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgagccgcaactccacccacgagatgtactggatcagcaacggcacggggaacatcgtggcctccgtgaacatggtcagccggctcctgctgaaccgcttcaccatgacccaccggcgcccgaccatcgagaaggacgtggacctcggcgcgggcacgcggcacatcaacgccgagcccgagacccccaacatggacgtgatcggggagcgcatcaagcggatcaaggaggagcacaactccacctggcactacgacgaggagaacccgtacaagacctgggcctaccacggcagctacgaggtcaaggccacggggtccgccagctccatgatcaacggcgtggtcaagctgctgaccaagccctgggacgtggtgcccatggtcacccagatggcgatgaccgacacgacccccttcgggcagcagcgcgtgttcaaggagaaggtggacacccggaccccgcgccccatgcccggcacgcggcgcgtcatgggcatcaccgccgagtggctctggcggaccctggggcgcaacaagaagccccggctgtgcacccgcgaggagttcacgaagaaggtgcgcaccaacgccgccatgggcgcggtgttcaccgaggagaaccagtgggacagcgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccggcggggccatgtacgccgacgacaccgcggggtgggacacgcgcatcaccgaggacgacctgcacaacgaggagaagatcacccagcagatggaccccgagcaccggcagctcgccaacgccatcttcaagctgacctaccagaacaaggtggtgaaggtccagcgccccacccccacggggaccgtgatggacatcatcagccggaaggaccagcgcggctccggccaggtgggcacctacgggctgaacaccttcacgaacatggaggcccagctcatccggcagatggagggcgagggggtcctgagcaaggccgacctggagaacccgcacctccccgagaagaagatcacccagtggctggagaccaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagccgagcaagggctggcacgactggcagcaggtccccttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgccggtccactgggtgcccacgtcccggaccacctggagcatccacgcccaccaccagtggatgaccacggaggacatgctgaccgtgtggaaccgcgtctggatcgaggacaacccctggatggaggacaagacccccgtgaccacgtgggagaacgtgccgtacctcgggaagcgggaggaccagtggtgcggctccctgatcgggctgaccagccgcgccacctgggcgcagaacatccccaccgccatccagcaggtccggagcctcatcggcaacgaggagttcctggactacatgccctccatgaagcgcttccggaaggaggaggagagcgagggggccatctggtga

SEQ ID NO: 10257 - RNA, 9873 nt, synthetic construct
  misc_feature 1..9873: note = derived and/or modified CDS sequence (opt1) from DENV-3__FJ639799__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaagatccccttcagcaccgaggacgggcagggcaaggcgcacaacggccgcctgatcacggccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtcgtggtgggggacatcatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgcccacccacctcgcccaccgcacccggaacgccctggacaacctggtgatgctccacacgtccgagcacggcgggaaggcctaccgccacgcggtcgaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccacgaagcgcgacctgggcatgagccgggagccgggggtcgtgtcccccaccagctacctggacgtggacctccaccccgcctccgcctggaccctgtacgccgtcgcgaccacggtgatcacccccatgctgcgccacaccatcgagaacagcaccgccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgacgctgaccgccgccgtgctcctgctgatcacccactacgccatcatcggccccggcctccaggcgaaggccacccgggaggcccagaagcgcacggccgccgggatcatgaagaacccgaccgtggacggcatcatgaccatcgacctggaccccgtcatctacgacagcaagttcgagaagcagctgggccaggtgatgctcctggtgctgtgcgcggtccagctcctgctgatgcggacctcctgggccctctgcgaggccctgacgctggccaccggccccatcaccaccctctgggagggcagccccgggaagttctggaacacgaccatcgcggtgtccatggccaacatcttccgcggcagctacctggccggggccggcctggccttctccatcatgaagtccgtggggaccggcaagcggggcaccgggtcccagggcgagaccctcggggagaagtggaagaagaagctgaaccagctgagccgcaaggagttcgacctctacaagaagtccggcatcacggaggtcgaccggaccgaggcgaaggaggggctgaagcgcggcgagatcacccaccacgccgtgtcccggggcagcgccaagctgcagtggttcgtggagcgcaacatggtcatcccggaggggcgggtgatcgacctcggctgcgggcgcggcgggtggtcctactactgcgccggcctgaagaaggtgaccgaggtccggggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccgcacgatccgcgtgctgaagatggtcgagccgtggctcaagaacaaccagttctgcatcaaggtgctgaacccctacatgcccgccgtgatcgagcacctggagcggctccagcgcaagcacggcgggatgctggtccggaaccccctgagccgcaactccacccacgagatgtactggatcagcaacggcaccgggaacatcgtggcgtccgtgaacatggtcagccggctcctgctgaaccgcttcaccatgacgcaccggcgcccgaccatcgagaaggacgtggacctcggcgccggcacccggcacgtgaacgccgagcccgagacccccaacatggacgtcatcggggagcgcatcaagcggatcaaggaggagcacaactccacgtggcactacgacgacgagaacccgtacaagacctgggcctaccacggcagctacgaggtgaaggccaccgggtccgcgagctccatgatcaacggcgtcgtgaagctgctgaccaagccctgggacgtggtccccatggtgacgcagatggccatgaccgacaccacccccttcgggcagcagcgcgtgttcaaggagaaggtcgacacgcggaccccgcgcagcatgcccggcacccggcgcgtgatgggcatcaccgccgagtggctctggcggacgctggggcgcaacaagaagccccggctgtgcacccgcgaggagttcaccaagaaggtgcgcaccaacgccgcgatgggcgccgtcttcacggaggagaaccagtgggacagcgccaaggccgccgtggaggacgaggacttctggaagctcgtggaccgggagcgcgagctgcacaagctggggaagtgcggctcctgcgtctacaacatgatggggaagcgggagaagaagctcggcgagttcggcaaggcgaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtggtcaaggtgcagcgccccacccccaccggcaccgtgatggacatcatctcccggaaggaccagcgcggcagcgggcaggtcggcacgtacgggctgaacaccttcaccaacatggaggcccagctcatccggcagatggagggcgagggggtgctgtccaaggcggacctggagaacccccacctcccggagaagaagatcacccagtggctggagacgaagggcgtggagcgcctgaagcggatggccatcagcggcgacgactgcgtcgtgaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtggtgccctgccggccccaggacgagctgatcggccgcgcgcggatctcccagggggccggctggagcctccgcgagaccgcctgcctgggcaaggcctacgcgcagatgtggtccctgatgtacttccaccgccgggacctccgcctggccagcaacgccatctgctccgccgtccccgtgcactgggtgccgaccagccggaccacgtggtccatccacgcccaccaccagtggatgaccaccgaggacatgctgaccgtctggaaccgcgtgtggatcgaggacaacccctggatggaggacaagacgcccgtgaccacctgggagaacgtcccctacctcgggaagcgggaggaccagtggtgcggcagcctgatcgggctgaccagccgcgcgacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10258 - RNA, 9873 nt, synthetic construct
  misc_feature 1..9873: note = derived and/or modified CDS sequence (opt1) from DENV-3__FJ639800__SS-prME
  source 1..9873: mol_type = other RNA
accagcctctgcctcatgatgatcctgcccgccgccctggcgttccacctcaccagccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgaggtccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaagatccccttcagcaccgaggacgggcagggcaaggcgcacaacggccgcctgatcacggccaaccccgtggtcaccaagaaggaggagcccgtgaacatcgaggccgagccgcccttcggggagagcaacatcgtgatcggcatcggggacaacgccctgcggatcaactggtacaagaagggctccagcatcgggaagatgttcgaggcgaccgcccgcggcgcccggcgcatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccggagcacgacccgcatggagaacctgctgtggaagcagatcgcgaacgagctcaactacatcctgtgggagaacaacatcaagctgaccgtcgtggtgggggacaccatcggcgtcctcgagcagggcaagcggacgctgacgccccagccgatggagctgaagtactcctggaagacctgggggaaggccaagatcgtgaccgccgagacgcagaacagctccttcatcatcgacggccccaacacccccgagtgccccagcgcctcccgcgcgtggaacgtgtgggaggtcgaggactacgggttcggcgtgttcaccaccaacatctggctcaagctgcgggaggtgtacacccagctgtgcgaccaccgcctcatgagcgccgccgtcaaggacgagcgggccgtgcacgccgacatgggctactggatcgagagccagaagaacgggtcctggaagctggagaaggcgagcctgatcgaggtgaagacgtgcacctggccgaagtcccacaccctctggagcaacggcgtcctggagtccgacatgatcatccccaagagcctggccgggcccatctcccagcacaactaccgcccgggctaccacacccagacggccgggccctggcacctcggcaagctggagctggacttcaactactgcgagggcaccaccgtggtgatcaccgagaactgcgggacgcggggccccagcctccgcaccaccaccgtctccgggaagctgatccacgagtggtgctgccggagctgcacgctgcccccgctccgctacatgggcgaggacgggtgctggtacggcatggagatccggcccatctccgagaaggaggagaacatggtgaagtccctggtgtccgccggcagcggggaggtcgacaacttcaccatgggcgtgctgtgcctcgccatcctgttcgaggaggtgatgcgcgggaagttcggcaagaagcacatgatcgcgggggtcttcttcaccttcgtgctgctcctgtccggccagatcacctggcgggacatggcccacacgctgatcatgatcggcagcaacgcctccgaccgcatggggatgggcgtgacctacctcgccctgatcgccaccttcaagatccagcccttcctggcgctcgggttcttcctgcggaagctgaccagccgcgagaacctcctgctgggcgtcggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtggcctggcggaccgccaccctgatcctcgcgggggtcagcctgctgccggtgtgccagtccagctccatgcgcaagaccgactggctccccatgacggtggccgccatgggcgtgccgcccctcccgctgttcatcttcaacctcaaggacaccctgaagcgccggagctggcccctgaacgagggggtgatggccgtgggcctcgtctccatcctggccagctccctgctccgcaacgacgtgcccatggcgggccccctggtggccgggggcctgctcatcgcctgctacgtcatcaccgggaccagcgccgacctgacggtggagaaggccgcggacgtgacctgggaggaggaggccgagcagaccggcgtctcccacaacctgatgatcaccgtggacgacgacgggaccatgcggatcaaggacgacgagacggagaacatcctcaccgtgctgctgaagaccgccctcctgatcgtcagcggcatcttcccgtactccatccccgccaccctgctcgtgtggcacacgtggcagaagcagacccagcgcagcggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacacgatgtggcacgtcacccgcggcgcggtgctcacctacaacgggaagcggctggagcccaactgggccagcgtgaagaaggacctgatctcctacggcgggggctggcgcctcagcgcccagtggcagaagggggaggaggtccaggtgatcgccgtggagcccggcaagaaccccaagaacttccagaccatgcccggcacgttccagaccaccaccggggagatcggcgcgatcgccctggacttcaagcccgggacgtccggcagccccatcatcaaccgggagggcaaggtcgtggggctgtacggcaacggggtggtcaccaagaacggcgggtacgtgagcggcatcgcccagaccaacgccgagccggacggccccacccccgagctggaggaggagatgttcaagaagcgcaacctcacgatcatggacctgcaccccgggtccggcaagacccggaagtacctgccggccatcgtgcgcgaggcgatcaagcggcgcctccggaccctgatcctggcccccacccgcgtcgtggccgccgagatggaggaggccctcaaggggctgcccatccggtaccagacgaccgcgaccaagagcgagcacaccggccgcgagatcgtggacctgatgtgccacgccacgttcaccatgcggctcctgtcccccgtccgcgtgccgaactacaacctgatcatcatggacgaggcccacttcaccgaccccgccagcatcgccgcgcgggggtacatctccacccgcgtgggcatgggcgaggccgccgccatcttcatgacggcgacgccgcccgggaccgccgacgccttcccgcagagcaacgcccccatccaggacgaggagcgcgacatccccgagcggtcctggaacagcggcaacgagtggatcaccgacttcgccgggaagacggtctggttcgtgccctccatcaaggcgggcaacgacatcgccaactgcctccgcaagaacgggaagaaggtgatccagctgagccggaagaccttcgacaccgagtaccagaagaccaagctgaacgactgggacttcgtcgtgacgaccgacatctccgagatgggcgccaacttcaaggccgaccgcgtgatcgacccgcggcgctgcctcaagcccgtcatcctgaccgacggccccgagcgggtgatcctggccgggcccatgccggtgaccgcggccagcgccgcccagcgccggggccgcgtcgggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagagccgcaagaccttcgtggagctgatgcggcgcggggacctccccgtctggctggcgcacaaggtggcctccgagggcatcaagtacaccgaccggaagtggtgcttcgacgggcagcgcaacaaccagatcctggaggagaacatggacgtggagatctggacgaaggagggcgagaagaagaagctccggccccgctggctggacgcccgcacctacagcgacccgctggccctcaaggagttcaaggacttcgccgcgggccggaagtccatcgccctggacctggtcaccgagatcgggcgcgtgcccacccacctcgcccaccggacgcgcaacgccctggacaacctggtgatgctccacaccagcgagcacggcgggaaggcctaccggcacgcggtcgaggagctgcccgagaccatggagaccctgctcctgctgggcctcatgatcctgctgaccggcggggccatgctgttcctgatctccgggaaggggatcggcaagaccagcatcgggctgatctgcgtgatcgccagctccggcatgctctggatggccgagatcccgctgcagtggatcgccagcgcgatcgtgctggagttcttcatgatggtcctcctgatccccgagcccgagaagcagcgcacgccccaggacaaccagctggcctacgtggtgatcgggatcctcaccctggccgccatcatcgccgcgaacgagatgggcctgctcgagacgaccaagcgggacctgggcatgtccaaggagccgggggtcgtgagccccacctcctacctggacgtggacctccaccccgccagcgcctggaccctgtacgccgtcgcgacgaccgtgatcacccccatgctgcgccacaccatcgagaactccacggccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgaccgccgccgtgctcctgctgatcacccactacgccatcatcggccccggcctccaggcgaaggccacgcgggaggcccagaagcgcaccgccgccgggatcatgaagaacccgaccgtggacggcatcatgaccatcgacctggaccccgtcatctacgactccaagttcgagaagcagctgggccaggtgatgctcctggtgctgtgcgcggtccagctcctgctgatgcggacgagctgggccctctgcgaggccctgaccctggccaccggccccatcaccacgctctgggagggctcccccgggaagttctggaacaccaccatcgcggtgagcatggccaacatcttccgcggctcctacctggccggggccggcctggccttcagcatcatgaagtccgtggggaccggcaagcggggcaccgggagccagggcgagacgctcggggagaagtggaagaagaagctgaaccagctgtcccgcaaggagttcgacctctacaagaagtccggcatcaccgaggtcgaccggaccgaggcgaaggaggggctgaagcgcggcgagatcacccaccacgccgtgagccggggctccgccaagctgcagtggttcgtggagcgcaacatggtcatcccggaggggcgggtgatcgacctcggctgcgggcgcggcgggtggagctactactgcgccggcctgaagaaggtgacggaggtccggggctacaccaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccacggtggaggagagccgcaccatccgcgtgctgaagatggtcgagccgtggctcaagaacaaccagttctgcatcaaggtgctgaacccctacatgcccaccgtgatcgagcacctggagcggctccagcgcaagcacggcgggatgctggtccggaaccccctgtcccgcaacagcacccacgagatgtactggatctccaacggcagcgggaacatcgtggcctccgtgaacatggtcagccggctcctgctgaaccgcttcacgatgacccaccggcgcccgaccatcgagaaggacgtggacctcggcgcgggcacccggcacgtgaacgccgagcccgagacgcccaacatggacgtcatcggggagcgcatcaagcggatcaaggaggagcacaactccacctggcactacgacgacgagaacccgtacaagacctgggcctaccacggcagctacgaggtgaaggccaccgggtccgccagctccatgatcaacggcgtcgtgaagctgctgacgaagccctgggacgtggtccccatggtgacccagatggcgatgaccgacaccacgcccttcgggcagcagcgcgtgttcaaggagaaggtcgacacccggaccccgcgcagcatgcccggcacccggcgcgtgatgggcatcacggccgagtggctctggcggaccctggggcgcaacaagaagccccggctgtgcacccgcgaggagttcaccaagaaggtgcgcacgaacgccgccatgggcgcggtcttcaccgaggagaaccagtgggacagcgccaaggccgccgtggaggacgaggacttctggaagctcgtggaccgggagcgcgagctgcacaagctggggaagtgcggctcctgcgtctacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccgggggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaccggcacggtgatggacatcatctcccggaaggaccagcgcggcagcgggcaggtcggcacctacgggctgaacaccttcaccaacatggaggcccagctcatccggcagatggagggcgagggggtgctgtccaaggccgacctggagaacccccacctcccggagaagaagatcacgcagtggctggagaccaagggcgtggagcgcctgaagcggatggcgatcagcggcgacgactgcgtcgtgaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtggtgccctgccggccccaggacgagctgatcggccgcgcccggatctcccagggggcgggctggagcctccgcgagaccgcctgcctgggcaaggcctacgcccagatgtggtccctgatgtacttccaccgccgggacctccgcctggcgagcaacgccatctgctccgccgtccccgtgcactgggtgccgaccagccggacgacctggtccatccacgcccaccaccagtggatgaccaccgaggacatgctgacggtctggaaccgcgtgtggatcgaggacaacccctggatggaggacaagacccccgtgaccacctgggagaacgtcccctacctcgggaagcgggaggaccagtggtgcggcagcctgatcgggctgacgagccgcgccacctgggcgcagaacatcccgaccgccatccagcaggtccggtccctcatcggcaacgaggagttcctggactacatgcccagcatgaagcgcttccggaaggaggaggagtccgagggggccatctggtga

SEQ ID NO: 10259 - RNA, 9873 nt, synthetic construct
  misc_feature 1..9873: note = derived and/or modified CDS sequence (opt1) from DENV-3__FJ639801__SS-prME
  source 1..9873: mol_type = other RNA
accagcctctgcctcatgatgatcctccccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctgacctgcaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtccccacccacctcgcccaccgcacgcggaacgccctggacaacctggtgatgctccacacctccgagcacggcgggaaggcctaccgccacgcggtggaggagctgcccgagaccatggagaccctgctcctgctgggcctcatgatcctgctgaccggcggggccatgctgttcctgatcagcgggaaggggatcggcaagaccagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccacgatcgccgcgaacgagatgggcctgctcgagaccaccaagcgcgacctgggcatgagcaaggagccgggggtggtctcccccaccagctacctggacgtggacctccaccccgcctccgcctggacgctgtacgccgtggcgaccaccgtcatcacccccatgctgcggcacacgatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtgatctacgacagcaagttcgagaagcagctggggcaggtcatgctcctggtgctgtgcgcggtgcagctcctgctgatgcgcacctcctgggccctctgcgaggccctgaccctggccaccggccccatcacgaccctctgggagggcagccccgggaagttctggaacaccaccatcgcggtctccatggccaacatcttccggggcagctacctggccggggccggcctggccttctccatcatgaagtccgtggggaccggcaagcgcggcacggggtcccagggcgagaccctcggggagaagtggaagaagcggctgaaccagctgagccgcaaggagttcgacctctacaagaagtccggcatcaccgaggtggaccggaccgaggcgaaggaggggctgaagcgcggcgagatcacgcaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtcgcctccgtgaacatggtgagccggctcctgctgaaccgcttcaccatgacccaccggcgcccgacgatcgagaaggacgtcgacctcggcgcgggcacccggcacgtgaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggccaccgggtccgccagctccatgatcaacggcgtggtcaagctgctgaccaagccctgggacgtggtgcccatggtcacccagatggcgatgacggacaccacccccttcgggcagcagcgcgtgttcaaggagaaggtggacacccggacgccgcgcagcatgcccggcacccggcgcgtcatgggcatcaccgccgagtggctctggcggaccctggggcgcaacaagaagccccggctgtgcacgcgcgaggagttcaccaagaaggtgcgcaccaacgccgccatgggcgcggtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgccgacgacacggcggggtgggacacccgcatcaccgaggacgacctgcacaacgaggagaagatcacccagcagatggacccggagcaccggcagctcgccaacgccatcttcaagctgacctaccagaacaaggtggtgaaggtccagcgccccacgcccaccggcaccgtgatggacatcatctcccggaaggaccagcgcggcagcggccaggtgggcacctacgggctgaacacgttcaccaacatggaggcccagctcatccggcagatggagggcgagggggtcctgtccaaggccgacctggagaacccccacctcccggagaagaagatcacccagtggctggagaccaagggcgtggagcgcctgaagcggatggcgatcagcggcgacgactgcgtggtcaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggcgggctggagcctccgcgagacggcctgcctgggcaaggcctacgcccagatgtggtccctgatgtacttccaccgccgggacctccgcctggcgagcaacgccatctgctccgccgtgcccgtccactgggtgccgaccagccggaccacctggtccatccacgcccaccaccagtggatgacgaccgaggacatgctgaccgtgtggaaccgcgtctggatcgaggacaacccctggatggaggacaagacccccgtgacgacctgggagaacgtgccctacctcgggaagcgggaggaccagtggtgcggcagcctgatcgggctgaccagccgcgccacctgggcgcagaacatcccgacggccatccagcaggtccggtccctcatcggcaacgaggagttcctggactacatgcccagcatgaagcgcttccggaaggaggaggagtccgagggggccatctggtga

SEQ ID NO: 10260 - RNA, 9873 nt, synthetic construct
  misc_feature 1..9873: note = derived and/or modified CDS sequence (opt1) from DENV-3__KF955471__SS-prME
  source 1..9873: mol_type = other RNA
accagcctgtgcctcatgatgatcctgcccgccgccctggcgttccacctcacctcccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcaacctcaaggacacgctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggaccagcgccgacctgaccgtcgagaaggccgcggacgtgacgtgggaggaggaggccgagcagaccggcgtgtcccacaacctgatgatcaccgtcgacgacgacgggaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctggaggaggagatgttcaagaagcggaacctcaccatcatggacctgcaccccgggtccggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagagcgagcacaccggccgggagatcgtggacctgatgtgccacgccaccttcacgatgcgcctcctgtcccccgtgcgggtcccgaactacaacctgatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctccggaagaacgggaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacggccccgagcgcgtcatcctggccgggcccatgccggtgaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggacttcgccgcgggccgcaagtccatcgccctggacctggtgaccgagatcgggcgggtccccacccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatctccggcaaggggatcggcaagacgagcatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgtccaaggagccgggggtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgacgctggccaccggccccatcaccaccctctgggagggctcccccgggaagttctggaacacgaccatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgtcccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcagcgggaacatcgtcgcctccgtgaacatggtgagccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaactccacgtggcactacgacgacgagaacccgtacaagacctgggcctaccacggcagctacgaggtcaaggccaccgggtccgccagctccatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatctcccgcaaggaccagcggggcagcggccaggtgggcacgtacgggctgaacaccttcaccaacatggaggcccagctcatccgccagatggagggcgagggggtcctgtccaaggccgacctggagaacccccacctcccggagaagaagatcacccagtggctggagacgaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcaccacgtggtccatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgaccagccgggccacgtgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10261 - RNA, 9873 nt, synthetic construct
  misc_feature 1..9873: note = derived and/or modified CDS sequence (opt1) from DENV-3__FJ639803__SS-prME
  source 1..9873: mol_type = other RNA
accagcctgtgcctcatgatgatcctgcccgccgccctggcgttccacctcacctcccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcaacctcaaggacacgctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggaccagcgccgacctgaccgtcgagaaggccgcggacgtgacgtgggaggaggaggccgagcagaccggcgtgtcccacaacctgatgatcaccgtcgacgacgacgggaccatgcgcatcaaggacgacgagaccgagaacatcctcacggtgctgctgaagaccgccctcctgatcgtgagcggcatcttcccgtactccatccccgccaccctgctcgtctggcacacctggcagaagcagacgcagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctggaggaggagatgttcaagaagcggaacctcaccatcatggacctgcaccccgggtccggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagagcgagcacaccggccgggagatcgtggacctgatgtgccacgccaccttcacgatgcgcctcctgtcccccgtgcgggtcccgaactacaacctgatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctccggaagaacgggaagaaggtgatccagctgagccgcaagacgttcgacaccgagtaccagaagaccaagctgaacgactgggacttcgtggtcaccacggacatctccgagatgggcgccaacttcaaggccgaccgggtgatcgacccgcgccggtgcctcaagcccgtgatcctgaccgacggccccgagcgcgtcatcctggccgggcccatgccggtgaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtacagcgacccgctggccctcaaggagttcaaggacttcgccgcgggccgcaagtccatcgccctggacctggtgaccgagatcgggcgggtccccacccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatctccggcaaggggatcggcaagacgagcatcgggctgatctgcgtcatcgtgagctccggcatgctctggatggccgagatcccgctgcagtggatcgccagcgccatcgtgctggagttcttcatgatggtcctcctgatccccgagcccgagaagcagcggacgccccaggacaaccagctggcgtacgtggtgatcgggatcctcaccctggccgccatcatcgccgccaacgagatgggcctgctcgagaccacgaagcgcgacctgggcatgtccaaggagccgggggtcgtgagccccacctcctacctggacgtggacctccaccccgcgagcgcctggaccctgtacgccgtcgccaccacggtgatcacccccatgctgcggcacaccatcgagaactccaccgcgaacgtgagcctcgccgccatcgccaaccaggccgtcgtgctgatgggcctggacaaggggtggccgatctccaagatggacctcggcgtgcccctgctggcgctcgggtgctacagccaggtcaaccccctgacgctgaccgccgccgtgctcctgctgatcacccactacgccatcatcggccccggcctccaggccaaggcgacccgcgaggcccagaagcggacggccgccgggatcatgaagaacccgaccgtggacggcatcatgaccatcgacctggaccccgtcatctacgactccaagttcgagaagcagctgggccaggtgatgctcctggtgctgtgcgccgtccagctcctgctgatgcgcaccagctgggcgctctgcgaggccctgacgctggccaccggccccatcaccaccctctgggagggctcccccgggaagttctggaacacgaccatcgccgtgagcatggcgaacatcttccggggctcctacctggccggggccggcctggccttcagcatcatgaagtccgtggggaccggcaagcgcggcaccgggagccagggcgagaccctcggggagaagtggaagaagaagctgaaccagctgtcccggaaggagttcgacctctacaagaagtccggcatcacggaggtcgaccgcaccgaggccaaggaggggctgaagcggggcgagatcacccaccacgcggtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacacgaagggcgggcccgggcacgaggagcccgtgcccatgtccacctacggctggaacatcgtgaagctgatgagcgggaaggacgtcttctacctcccgcccgagaagtgcgacaccctgctgtgcgacatcggcgagtccagcccctcccccaccgtggaggagagccggacgatccgcgtgctgaagatggtcgagccgtggctcaagaacaaccagttctgcatcaaggtgctgaacccctacatgcccaccgtgatcgagcacctggagcgcctccagcggaagcacggcgggatgctggtccgcaaccccctgtcccggaacagcacccacgagatgtactggatctccaacggcagcgggaacatcgtggcctccgtgaacatggtcagccgcctcctgctgaaccggttcaccatgacgcaccgccggccgaccatcgagaaggacgtggacctcggcgccggcacccgccacgtgaacgcggagcccgagacccccaacatggacgtcatcggggagcggatcaagcgcatcaaggaggagcacaactccacgtggcactacgacgacgagaacccgtacaagacctgggcctaccacggcagctacgaggtgaaggccaccgggtccgccagctccatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgcggagtggctctggcgcacgctggggcggaacaagaagccccgcctgtgcacccgggaggagttcaccaagaaggtgcgcaccaacgccgccatgggcgccgtcttcacggaggagaaccagtgggacagcgcgaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgccgggtgggacacccggatcaccgaggacgacctgcacaacgaggagaagatcacgcagcagatggacccggagcaccgccagctcgcgaacgccatcttcaagctgacctaccagaacaaggtggtcaaggtgcagcggcccacccccaccggcaccgtgatggacatcatctcccgcaaggaccagcggggcagcgggcaggtcggcacgtacgggctgaacaccttcaccaacatggaggcccagctcatccgccagatggagggcgagggggtgctgtccaaggccgacctggagaacccccacctcccggagaagaagatcacccagtggctggagacgaagggcgtggagcggctgaagcgcatggccatcagcggcgacgactgcgtcgtgaagcccatcgacgaccggttcgcgaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcccgcatctcccagggggccggctggagcctccgggagaccgcgtgcctgggcaaggcctacgcccagatgtggtccctgatgtacttccaccgccgcgacctccggctggccagcaacgcgatctgctccgccgtccccgtgcactgggtgccgaccagccgcaccacgtggtccatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgaccagccgggccacgtgggcccagaacatcccgaccgcgatccagcaggtccgctccctcatcggcaacgaggagttcctggactacatgcccagcatgaagcggttccgcaaggaggaggagtccgagggggccatctggtga

SEQ ID NO: 10262 - RNA, 9873 nt, synthetic construct
  misc_feature 1..9873: note = derived and/or modified CDS sequence (opt1) from DENV-3__FJ639804__SS-prME
  source 1..9873: mol_type = other RNA
accagcctgtgcctcatgatgatcctgcccgccgccctggcgttccacctcacctcccgggacggggagccccggatgatcgtggggaagaacgagcggggcaagagcctgctgttcaagaccgcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagtcccaggtgggcgtgggggtccagaaggagggcgtgttccacaccatgtggcacgtgacccggggcgcggtcctcacgtacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagaccatgcccggcaccttccagaccacgaccggggagatcggcgcgatcgccctggacttcaagcccgggaccagcggctcccccatcatcaaccgcgagggcaagatcgtggggctgtacggcaacggggtcgtgaccaagaacggcgggtacgtgagcggcatcgcccagacgaacgccgagccggacggccccacccccgagctggaggaggagatgttcaagaagcggaacctcaccatcatggacctgcaccccgggtccggcaagacccgcaagtacctgccggccatcgtccgggaggcgatcaagcgccggctccgcacgctgatcctggcccccacccgggtggtggccgccgagatggaggaggccctcaaggggctgcccatccgctaccagaccaccgcgaccaagagcgagcacacgggccgggagatcgtcgacctgatgtgccacgccaccttcaccatgcgcctcctgtcccccgtgcgggtgccgaactacaacctgatcatcatggacgaggcccacttcacggaccccgccagcatcgccgcgcgcgggtacatctccacccgggtcggcatgggcgaggccgccgccatcttcatgaccgcgacgccgcccgggacggccgacgccttcccgcagagcaacgcccccatccaggacgaggagcgcgacatccccgagcgctcctggaacagcggcaacgagtggatcaccgacttcgccgggaagaccgtgtggttcgtgccctccatcaaggcgggcaacgacatcgccaactgcctccggaagaacgggaagaaggtcatccagctgagccgcaagaccttcgacacggagtaccagaagaccaagctgaacgactgggacttcgtggtgaccaccgacatctccgagatgggcgccaacttcaaggccgaccgggtcatcgacccgcgccggtgcctcaagcccgtgatcctgacggacggccccgagcgcgtgatcctggccgggcccatgccggtcaccgcggccagcgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagacgttcgtggagctgatgcgccgcggggacctccccgtctggctggcgcacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctacagcgacccgctggccctcaaggagttcaaggacttcgccgcgggccgcaagtccatcgccctggacctggtgacggagatcgggcgggtgcccacccacctcgcccaccgcacccggaacgccctggacaacctggtcatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccaccatcgccgcgaacgagatgggcctgctcgagaccacgaagcgcgacctgggcatgtccaaggagccgggggtggtgagccccacctcctacctggacgtcgacctccaccccgccagcgcctggaccctgtacgccgtggcgaccacggtgatcacccccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgacgctgaccgccgccgtgctcctgctgatcacccactacgccatcatcggccccggcctccaggcgaaggccacccgcgaggcccagaagcggacggccgccgggatcatgaagaacccgaccgtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgacgctggccaccggccccatcaccaccctctgggagggctcccccgggaagttctggaacacgaccatcgcggtgagcatggccaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacacgaagggcgggcccgggcacgaggagcccgtgcccatgtccacctacggctggaacatcgtcaagctgatgagcgggaaggacgtgttctacctcccgcccgagaagtgcgacaccctgctgtgcgacatcggcgagtccagcccctcccccaccgtggaggagagccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcacgatgacctaccgccggccgaccatcgagaaggacgtggacctcggcgcgggcacccgccacgtcaacgccgagcccgagacgcccaacatggacgtgatcggggagcggatcgagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctgctgacgaagccctgggacgtcgtgcccatggtgacccagatggcgatgaccgacaccacgcccttcgggcagcagcgggtcttcaaggagaaggtggacacccgcatcccgcggagcatgcccggcacccgccgggtgatgggcatcaccgccgagtggctctggcgcacgctggggcggaacaagaagccccgcctgtgcacccgggaggagttcaccaagaaggtccgcaccaacgccgccatgggcgcggtgttcacggaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggccgacctggagaacccccacctcccggagaagaagatcacccagtggctggagacgaagggcgtcgagcggctgcgccggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtgcactgggtcccgacctcccggaccacgtggagcatccacgcccaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10263 - RNA, 9873 nt, synthetic construct
  misc_feature 1..9873: note = derived and/or modified CDS sequence (opt1) from DENV-3__FJ639805__SS-prME
  source 1..9873: mol_type = other RNA
accagcctgtgcctcatgatgatcctgcccgccgccctggcgttccacctcacctcccgggacggggagccgcggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcctgaccttcgtcctcctgctgtccggccagatcacctggcgcgacatggcccacaccctcatcatgatcggcagcaacgcctccgaccggatggggatgggcgtgacgtacctggccctgatcgccaccttcaagatccagcccttcctcgcgctggggttcttcctgcgcaagctcaccagccgggagaacctgctgctcggcgtgggcctggccatggccaccacgctgcagctccccgaggacatcgagcagatggccaacgggatcgcgctgggcctgatggccctcaagctgatcacccagttcgagacctaccagctgtggaccgccctcatcagcctgacgtgctccaacaccatcttcaccctgaccgtcgcctggcgcacggccaccctcatcctggcgggggtgagcctgctcccggtctgccagtccagctccatgcggaagaccgactggctgcccatgaccgtggccgccatgggcgtgccgcccctgcccctgttcatcttcaacctgaaggacacgctgcgccgccggagctggcccctcaacgagggggtcatggccgtgggcctggtgtccatcctggccagctccctcctgcgcaacgacgtccccatggcgggccccctggtggccgggggcctcctgatcgcctgctacgtgatcaccgggaccagcgccgacctgaccgtcgagaaggccgcggacgtgacgtgggaggaggaggccgagcagaccggcgtgtcccacaacctcatgatcaccgtcgacgacgacgggaccatgcggatcaaggacgacgagaccgagaacatcctgacggtgctgctcaagaccgccctgctgatcgtgagcggcatcttcccgtactccatccccgccaccctcctggtctggcacacctggcagaagcagacgcagcgcagcggcgtgctgtgggacgtgcccagcccgcccgagacccagaaggccgagctcgaggagggggtctaccggatcaagcagcagggcatcttcgggaagacccaggtgggcgtgggggtccagaaggagggcgtgttccacaccatgtggcacgtgacgcgcggcgcggtcctgacctacaacgggaagcggctggagcccaactgggccagcgtgaagaaggacctcatctcctacggcgggggctggcgcctgagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggacctccggcagccccatcatcaaccgggagggcaaggtggtcgggctgtacggcaacggggtggtgacgaagaacggcgggtacgtcagcggcatcgcccagaccaacgccgagccggacggccccacccccgagctcgaggaggagatgttcaagaagcgcaacctgaccatcatggacctgcaccccgggtccggcaagacgcggaagtacctcccggccatcgtgcgcgaggcgatcaagcggcgcctgcggaccctgatcctcgcccccacccgcgtggtcgccgccgagatggaggaggccctgaaggggctgcccatccggtaccagaccacggcgaccaagagcgagcacaccggccgcgagatcgtggacctcatgtgccacgccaccttcacgatgcggctgctgtcccccgtgcgcgtcccgaactacaacctcatcatcatggacgaggcccacttcaccgaccccgccagcatcgccgcgcgggggtacatctccacccgcgtgggcatgggcgaggccgccgccatcttcatgaccgcgacgccgcccgggaccgccgacgccttcccgcagagcaacgcccccatccaggacgaggagcgcgacatccccgagcggtcctggaacagcggcaacgagtggatcaccgacttcgccgggaagaccgtgtggttcgtcccctccatcaaggcgggcaacgacatcgccaactgcctgcgcaagaacgggaagaaggtgatccagctgagccggaagacgttcgacaccgagtaccagaagaccaagctcaacgactgggacttcgtggtcaccacggacatctccgagatgggcgccaacttcaaggccgaccgcgtgatcgacccgcggcgctgcctgaagcccgtgatcctgaccgacggccccgagcgggtcatcctcgccgggcccatgccggtgaccgcggccagcgccgcccagcgccggggccgcgtggggcggaacccccagaaggagaacgaccagtacatcttcaccggccagcccctgaacaacgacgaggaccacgcccactggaccgaggcgaagatgctgctcgacaacatcaacacgcccgaggggatcatcccggccctgttcgagcccgagcgcgagaagtccgccgccatcgacggcgagtaccggctgaagggcgagagccgcaagaccttcgtcgagctcatgcggcgcggggacctgcccgtgtggctggcgcacaaggtcgcctccgagggcatcaagtacaccgaccggaagtggtgcttcgacgggcagcgcaacaaccagatcctcgaggagaacatggacgtggagatctggaccaaggagggcgagaagaagaagctgcggccccgctggctggacgcccgcacgtacagcgacccgctcgccctgaaggagttcaaggacttcgccgcgggccggaagtccatcgccctggacctcgtgaccgagatcgggcgcgtccccacccacctggcccaccggacccgcaacgccctggacaacctcgtgatgctgcacacgagcgagcacggcgggaaggcctaccggcacgcggtggaggagctgcccgagaccatggagaccctcctgctgctcggcctgatgatcctgctcaccgggggcgccatgctgttcctgatctccggcaaggggctcggcaagacgagcatcgggctgatctgcgtcatcgccagctccggcatgctgtggatggccgagatcccgctccagtggatcgccagcgcgatcgtgctggagttcttcatgatggtgctgctcatccccgagcccgagaagcagcgcacgccccaggacaaccagctggcctacgtcgtgatcgggatcctgaccctcgccgccatcatcgccgcgaacgagatgggcctgctggagaccacgaagcgggacctcggcatgtccaaggagccgggggtggtcagccccacctcctacctggacgtggacctgcaccccgccagcgcctggaccctctacgccgtggcgaccacggtcatcacccccatgctgcgccacaccatcgagaactccaccgccaacgtgagcctggccgccatcgccaaccaggcggtggtcctcatgggcctggacaaggggtggccgatctccaagatggacctgggcgtgcccctcctggccctggggtgctacagccaggtgaaccccctcacgctgaccgccgccgtcctgctcctgatcacccactacgccatcatcggccccggcctgcaggcgaaggccacccgggaggcccagaagcgcacggccgccgggatcatgaagaacccgaccgtggacggcatcatgaccatcgacctcgaccccgtgatctacgactccaagttcgagaagcagctggggcaggtcatgctgctcgtgctgtgcgcggtgcagctgctcctgatgcggaccagctgggccctgtgcgaggccctcacgctggccaccggccccatcaccaccctgtgggagggctcccccgggaagttctggaacacgaccatcgcggtcagcatggccaacatcttccgcggctcctacctcgccggggccggcctggccttcagcatcatgaagtccgtggggaccggcaagcggggcaccgggagccagggcgagaccctgggggagaagtggaagaagaagctcaaccagctgtcccgcaaggagttcgacctgtacaagaagtccggcatcacggaggtggaccggaccgaggcgaaggaggggctcaagcgcggcgagatcacccaccacgccgtcagccggggctccgccaagctgcagtggttcgtggagcgcaacatggtgatcccggaggggcgggtcatcgacctgggctgcgggcgcggcgggtggagctactactgcgccggcctcaagaaggtgaccgaggtgcggggctacacgaagggcgggcccgggcacgaggagcccgtccccatgtccacctacggctggaacatcgtgaagctgatgagcgggaaggacgtgttctacctgccgcccgagaagtgcgacaccctgctctgcgacatcggcgagtccagcccctcccccaccgtcgaggagagccgcacgatccgcgtgctgaagatggtggagccgtggctgaagaacaaccagttctgcatcaaggtcctcaacccctacatgcccaccgtgatcgagcacctggagcggctgcagcgcaagcacggcgggatgctcgtgcggaaccccctgtcccgcaacagcacccacgagatgtactggatctccaacggcaccgggaacatcgtcgccagcgtgaacatggtgtcccggctgctcctgaaccgcttcacgatgacccaccggcgcccgaccatcgagaaggacgtcgacctgggcgcgggcacccggcacgtgaacgccgagcccgagacgcccaacatggacgtgatcggggagcgcatcaagcggatcaaggaggagcacaacagcacctggcactacgacgacgagaacccgtacaagacctgggcctaccacggctcctacgaggtcaaggccaccgggagcgcctccagcatgatcaacggcgtggtcaagctcctgacgaagccctgggacgtggtgcccatggtcatccagatggcgatgaccgacaccacccccttcgggcagcagcgcgtgttcaaggagaaggtggacacgcggaccccgcgctccatgcccggcacccggcgcgtcatgggcatcaccgccgagtggctgtggcggacgctcgggcgcaacaagaagccccggctgtgcacccgcgaggagttcaccaagaaggtgcgcaccaacgccgccatgggcgcggtgttcacggaggagaaccagtgggacagcgccaaggccgccgtcgaggacgaggacttctggaagctggtggaccgggagcgcgagctccacaagctggggaagtgcggcagctgcgtgtacaacatgatggggaagcgggagaagaagctgggcgagttcggcaaggccaaggggtcccgcgcgatctggtacatgtggctcggcgcccggtacctggagttcgaggccctggggttcctcaacgaggaccactggttcagccgcgagaactcctacagcggcgtcgagggggagggcctgcacaagctgggctacatcctccgggacatctccaagatccccgggggcgccatgtacgccgacgacaccgcggggtgggacacccgcatcaccgaggacgacctgcacaacgaggagaagatcacgcagcagatggacccggagcaccggcagctggccaacgccatcttcaagctcacctaccagaacaaggtggtgaaggtccagcgccccacccccaccggcaccgtgatggacatcatcagccggaaggaccagcgcggctccggccaggtgggcacgtacgggctgaacaccttcaccaacatggaggcccagctgatccggcagatggagggcgagggggtcctcagcaaggccgacctggagaacccccacctcccggagaagaagatcacccagtggctcgagacgaagggcgtggagcgcctgaagcggatggcgatctccggcgacgactgcgtggtcaagcccatcgacgaccgcttcgccaacgccctgctcgccctgaacgacatggggaaggtgcggaaggacatcccccagtggcagcccagcaagggctggcacgactggcagcaggtcccgttctgctcccaccacttccacgagctgatcatgaaggacgggcgcaagctcgtcgtgccctgccggccccaggacgagctgatcggccgcgcccggatcagccagggggcgggctggtccctgcgcgagaccgcctgcctcggcaaggcctacgcccagatgtggagcctgatgtacttccaccgccgggacctgcgcctcgcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccgtgaccacctgggagaacgtgccctacctggggaagcgggaggaccagtggtgcggctccctcatcgggctgaccagccgcgccacgtgggcgcagaacatcccgaccgccatccagcaggtccggagcctgatcggcaacgaggagttcctcgactacatgccctccatgaagcgcttccggaaggaggaggagagcgagggggccatctggtga

SEQ ID NO: 10264 - RNA, 9873 nt, synthetic construct
  misc_feature 1..9873: note = derived and/or modified CDS sequence (opt1) from DENV-3__FJ639807__SS-prME
  source 1..9873: mol_type = other RNA
accagcctctgcctcatgatgatcctgcccgccgccctggcgttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtccccacccacctcgcccaccgcacgcggaacgccctggacaacctggtgatgctccacacctccgagcacggcgggaaggcctaccgccacgcggtggaggagctgcccgagaccatggagaccctgctcctgctgggcctcatgatcctgctgaccggcggggccatgctgttcctgatcagcgggaaggggatcggcaagaccagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccacgatcgccgcgaacgagatgggcctgctcgagaccaccaagcgcgacctgggcatgagcaaggagccgggggtggtctcccccaccagctacctggacgtggacctccaccccgcctccgcctggacgctgtacgccgtggcgaccaccgtcatcacccccatgctgcggcacacgatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgaccgccgccgtcctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtgatctacgacagcaagttcgagaagcagctggggcaggtcatgctcctggtgctgtgcgcggtgcagctcctgctgatgcgcacctcctgggccctctgcgaggccctgaccctggccaccggccccatcacgaccctctgggagggcagccccgggaagttctggaacaccaccatcgcggtctccatggccaacatcttccggggcagctacctggccggggccggcctggccttctccatcatgaagtccgtggggaccggcaagcgcggcacggggtcccagggcgagaccctcggggagaagtggaagaagcggctgaaccagctgagccgcaaggagttcgacctctacaagaagtccggcatcaccgaggtggaccggaccgaggcgaaggaggggctgaagcgcggcgagatcacgcaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgaccgaggtgcggggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtcgcctccgtgaacatggtgagccggctcctgctgaaccgcttcaccatgacccaccggcgcccgacgatcgagaaggacgtcgacctcggcgcgggcacccggcacgtgaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggccaccgggtccgccagctccatgatcaacggcgtggtcaagctgctgaccaagccctgggacgtggtgcccatggtcacccagatggcgatgacggacaccacccccttcgggcagcagcgcgtgttcaaggagaaggtggacacccggacgccgcgcagcatgcccggcacccggcgcgtcatgggcatcaccgccgagtggctctggcggaccctggggcgcaacaagaagccccggctgtgcacgcgcgaggagttcaccaagaaggtgcgcaccaacgccgccatgggcgcggtgttcaccgaggagaaccagtgggacagcgccaaggccgccgtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgccgacgacacggcggggtgggacacccgcatcaccgaggacgacctgcacaacgaggagaagatcacccagcagatggacccggagcaccggcagctcgccaacgccatcttcaagctgacctaccagaacaaggtggtgaaggtccagcgccccacgcccaccggcaccgtgatggacatcatctcccggaaggaccagcgcggcagcggccaggtgggcacctacgggctgaacacgttcaccaacatggaggcccagctcatccggcagatggagggcgagggggtcctgtccaaggccgacctggagaacccccacctcccggagaagaagatcacccagtggctggagaccaagggcgtggagcgcctgaagcggatggcgatcagcggcgacgactgcgtggtcaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggcgggctggagcctccgcgagacggcctgcctgggcaaggcctacgcccagatgtggtccctgatgtacttccaccgccgggacctccgcctggcgagcaacgccatctgctccgccgtgcccgtccactgggtgccgaccagccggaccacctggtccatccacgcccaccaccagtggatgacgaccgaggacatgctgaccgtgtggaaccgcgtctggatcgaggacaacccctggatggaggacaagacccccgtgacgacctgggagaacgtgccctacctcgggaagcgggaggaccagtggtgcggcagcctgatcgggctgaccagccgcgccacctgggcgcagaacatcccgacggccatccagcaggtccggtccctcatcggcaacgaggagttcctggactacatgcccagcatgaagcgcttccggaaggaggaggagtccgagggggccatctggtga

SEQ ID NO: 10265 - RNA, 9873 nt, synthetic construct
  misc_feature 1..9873: note = derived and/or modified CDS sequence (opt1) from DENV-3__FJ639810__SS-prME
  source 1..9873: mol_type = other RNA
accagcctgtgcctcatgatgatcctgcccgcggccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcccggatcgtcaccgccgagacgcagaacagctccttcatcatcgacggccccaacacccccgagtgccccaacaccagccgcgcctggaacgtgtgggaggtggaggactacgggttcggcgtcttcaccaccaacatctggctcaagctgcgggaggtgtacacgcagctgtgcgaccaccgcctcatgtccgcggccgtgaaggacgagcgggccgtccacgccgacatgggctactggatcgagagccagaagaacgggagctggaagctggagaaggcctccctgatcgaggtgaagacctgcacctggcccaagagccacaccctctggtccaacggcgtgctggagagcgacatgatcatccccaagtccctggcggggcccatcagccagcacaactaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcagcgagaaggaggagaacatggtcaagtccctggtgagcgccggctccggggaggtggacaacttcaccatgggcgtcctgtgcctcgccatcctgttcgaggaggtgatgcgcgggaagttcggcaagaagcacatgatcgccggggtgctgttcaccttcgtcctcctgctgagcggccagatcacgtggcgggacatggcgcacaccctcatcatgatcggctccaacgccagcgaccgcatggggatgggcgtgacctacctggccctgatcgccaccttcaagatccagcccttcctcgccctggggttcttcctgcggaagctcacgtcccgcgagaacctgctgctcggcgtgggcctggcgatggccaccaccctgcagctccccgaggacatcgagcagatggccaacgggatcgccctgggcctgatggcgctcaagctgatcacccagttcgagacgtaccagctgtggaccgccctcatcagcctgacctgcagcaacaccatcttcacgctgaccgtcgcctggcggaccgccaccctcatcctggccggggtgtccctgctcccggtctgccagagctccagcatgcgcaagacggactggctgcccatgaccgtggcggccatgggcgtgccgcccctgcccctgttcatcttctgcctgaaggacaccctgaagcgccggtcctggcccctcaacgagggggtcatggccgtgggcctggtgagcatcctggcctccagcctcctgcgcaacgacgtccccatggccggccccctggtggccggcgggctcctgatcgcctgctacgtgatcaccgggacgtccgccgacctgaccgtcgagaaggccgccgacgtgacctgggaggaggaggcggagcagaccggggtgagccacaacctcatgatcaccgtcgacgacgacgggacgatgcggatcaaggacgacgagaccgagaacatcctgaccgtgctgctcaagaccgccctgctgatcgtgtccggcatcttcccgtacagcatccccgccacgctcctggtctggcacacctggcagaagcagacccagcgctccggcgtgctgtgggacgtgccctccccgcccgagacccagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacctacaacgggaagcggctggagcccaactgggcgtccgtgaagaaggacctcatcagctacggcgggggctggcgcctgtccgcccagtggcagaagggggaggaggtgcaggtcatcgccgtggagcccggcaagaaccccaagaacttccagacgatgccgggcaccttccagaccaccacgggggagatcggcgccatcgcgctggacttcaagcccgggaccagcggctcccccatcatcaaccgggagggcaaggtggtcgggctgtacggcaacggggtggtgaccaagaacggcgggtacgtcagcggcatcgcccagaccaacgccgagccggacggccccacgcccgagctcgaggaggagatgttcaagaagcgcaacctgaccatcatggacctgcaccccgggagcggcaagacccggaagtacctcccggccatcgtgcgcgaggccatcaagcggcgcctgcggaccctgatcctcgcgcccacgcgcgtggtcgccgccgagatggaggaggccctgaaggggctgcccatccggtaccagaccaccgccaccaagtccgagcacacgggccgcgagatcgtggacctcatgtgccacgcgaccttcaccatgcggctgctgagccccgtgcgcgtcccgaactacaacctcatcatcatggacgaggcccacttcaccgaccccgcctccatcgccgcccgggggtacatcagcacgcgcgtgggcatgggcgaggcggccgccatcttcatgaccgccacgccgcccgggaccgcggacgccttcccgcagtccaacgcccccatccaggacgaggagcgcgacatccccgagcggagctggaactccggcaacgagtggatcacggacttcgccgggaagaccgtgtggttcgtccccagcatcaaggccggcaacgacatcgcgaactgcctgcgcaagaacgggaagaaggtgatccagctgtcccggaagaccttcgacaccgagtaccagaagacgaagctcaacgactgggacttcgtggtcaccaccgacatcagcgagatgggcgccaacttcaaggccgaccgcgtgatcgacccgcggcgctgcctgaagcccgtgatcctgaccgacggccccgagcgggtcatcctcgccgggcccatgccggtgaccgccgcgtccgccgcccagcgccggggccgcgtggggcggaacccccagaaggagaacgaccagtacatcttcacgggccagcccctgaacaacgacgaggaccacgcccactggaccgaggccaagatgctgctcgacaacatcaacacccccgaggggatcatgccggcgctgttcgagcccgagcgcgagaagtccgccgccatcgacggcgagtaccggctgaagggcgagtcccgcaagaccttcgtcgagctcatgcggcgcggggacctgcccgtgtggctggcccacaaggtcgcgagcgagggcatcaagtacacggaccggaagtggtgcttcgacgggcagcgcaacaaccagatcctcgaggagaacatggacgtggagatctggaccaaggagggcgagaagaagaagctgcggccccgctggctggacgcccgcacctactccgacccgctcgccctgaaggagttcaaggacttcgccgccggccgcaagagcatcgcgctggacctcgtgaccgagatcgggcgcgtccccacgcacctggcccaccggacccgcaacgccctggacaacctcgtgatgctgcacacctccgagcacggcgggaaggcctaccggcacgccgtggaggagctgcccgagaccatggagacgctcctgctgctcggcctgatgatcctgctcaccgggggcgcgatgctgttcctgatcagcggcaaggggatcggcaagacctccatcgggctcatctgcgtcatcgccagcagcggcatgctgtggatggccgagatcccgctgcagtggatcgcctccgccatcgtgctcgagttcttcatgatggtgctgctgatccccgagcccgagaagcagcgcacgccccaggacaaccagctcgcgtacgtcgtgatcgggatcctgacgctggccgccatcatcgccgccaacgagatgggcctcctggagaccaccaagcgggacctgggcatgagcaaggagccgggggtggtctcccccaccagctacctcgacgtggacctgcaccccgcgtccgcctggacgctgtacgccgtggccaccaccgtcatcacccccatgctccgccacacgatcgagaacagcaccgcgaacgtgtccctggccgccatcgccaaccaggccgtggtcctgatgggcctcgacaaggggtggccgatcagcaagatggacctgggcgtgcccctgctcgcgctggggtgctactcccaggtgaaccccctgaccctcaccgccgccgtcctgctgctcatcacgcactacgccatcatcggccccggcctgcaggccaaggcgacccgggaggcccagaagcgcaccgccgccgggatcatgaagaacccgaccgtggacggcatcatgacgatcgacctggaccccgtgatctacgacagcaagttcgagaagcagctcgggcaggtcatgctgctggtgctctgcgccgtgcagctgctgctcatgcggacctcctgggcgctgtgcgaggccctgaccctcgccaccggccccatcacgaccctgtgggagggcagccccgggaagttctggaacaccaccatcgccgtctccatggcgaacatcttccgcggcagctacctggccggggccggcctcgccttctccatcatgaagtccgtggggaccggcaagcggggcacggggtcccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagatcacgcaccacgcggtcagccggggcagcgccaagctccagtggttcgtggagcgcaacatggtgatcccggaggggcgggtcatcgacctgggctgcgggcgcggcgggtggtcctactactgcgccggcctgaagaaggtgaccgaggtgcggggctacaccaagggcgggcccgggcacgaggagcccgtccccatgagcacctacggctggaacatcgtgaagctcatgtccgggaaggacgtgttctacctgccgcccgagaagtgcgacacgctgctgtgcgacatcggcgagagctcccccagccccaccgtcgaggagtcccgcaccatccgcgtgctcaagatggtggagccgtggctgaagaacaaccagttctgcatcaaggtcctgaacccctacatgcccgccgtgatcgagcacctcgagcggctgcagcgcaagcacggcgggatgctggtgcggaaccccctcagccgcaactccacccacgagatgtactggatcagcaacggcacggggaacatcgtcgcctccgtgaacatggtgagccggctgctgctcaaccgcttcaccatgacccaccggcgcccgaccatcgagaaggacgtcgacctgggcgcgggcacgcggcacgtgaacgccgagcccgagacccccaacatggacgtgatcggggagcgcatcaagcggatcaaggaggagcacaactccacctggcactacgacgacgagaacccgtacaagacctgggcctaccacggcagctacgaggtcaaggccacggggtccgccagctccatgatcaacggcgtggtcaagctgctcaccaagccctgggacgtggtgcccatggtcacccagatggcgatgaccgacacgacccccttcgggcagcagcgcgtgttcaaggagaaggtggacacccggaccccgcgcagcatgcccggcacgcggcgcgtcatgggcatcaccgccgagtggctgtggcggaccctggggcgcaacaagaagccccggctctgcacccgcgaggagttcacgaagaaggtgcgcaccaacgccgccatgggcgcggtgttcaccgaggagaaccagtgggactccgccaaggccgccgtcgaggacgaggacttctggaagctggtggaccgggagcgcgagctgcacaagctcgggaagtgcggcagctgcgtgtacaacatgatggggaagcgggagaagaagctgggcgagttcggcaaggccaaggggagccgcgcgatctggtacatgtggctgggcgcccggtacctcgagttcgaggccctggggttcctgaacgaggaccactggttctcccgcgagaacagctactccggcgtcgagggggagggcctccacaagctgggctacatcctgcgggacatcagcaagatccccgggggcgccatgtacgccgacgacaccgcggggtgggacacgcgcatcaccgaggacgacctctacaacgaggagaagatcacccagcagatggacccggagcaccggcagctggccaacgccatcttcaagctgacctaccagaacaaggtggtgaaggtccagcgccccacccccacgggcaccgtgatggacatcatctcccggaaggaccagcgcggcagcggccaggtgggcacctacgggctcaacaccttcacgaacatggaggcccagctgatccggcagatggagggcgagggggtcctgtccaaggccgacctcgagaacccccacctcccggagaagaagatcacccagtggctggagaccaagggcgtggagcgcctcaagcggatggcgatcagcggcgacgactgcgtggtcaagcccatcgacgaccgcttcgccaacgccctgctggccctcaacgacatggggaaggtgcggaaggacatcccccagtggcagccctccaagggctggcacgactggcagcaggtcccgttctgcagccaccacttccacgagctgatcatgaaggacgggcgcaagctggtcgtgccctgccggccccaggacgagctcatcggccgcgcccggatctcccagggggcgggctggagcctgcgcgagaccgcctgcctgggcaaggcctacgcccagatgtggtccctcatgtacttccaccgccgggacctgcgcctggcgagcaacgccatctgctccgccgtgcccgtccactgggtgccgacgagccggaccacctggtccatccacgcccaccaccagtggatgaccacggaggacatgctcaccgtgtggaaccgcgtctggatcgaggacaacccctggatggaggacaagacccccgtgaccacgtgggagaacgtgccctacctggggaagcgggaggaccagtggtgcggcagcctgatcgggctcacctcccgcgccacctgggcgcagaacatcccgaccgccatccagcaggtccggagcctgatcggcaacgaggagttcctggactacatgcccagcatgaagcgcttccggaaggaggaggagtccgagggggccatctggtga

SEQ ID NO: 10266 - RNA, 9873 nt, synthetic construct
  misc_feature 1..9873: note = derived and/or modified CDS sequence (opt1) from DENV-3__FJ639816__SS-prME
  source 1..9873: mol_type = other RNA
accagcctctgcctcatgatgatcctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgggacaagcggagcgtggccctcgcgccccacgtgggcatggggctggacacccgcacccagacctggatgagcgcggagggcgcctggcgccaggtggagaaggtcgagacctgggccctgcgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcggtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggccatcctgcccgagtacggcaccctggggctcgagtgctccccgcgcacgggcctggacttcaacgagatgatcctgctcaccatgaagaacaaggcgtggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgccatgcacacggcgctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgagcaggggaaggcccacaacggccgcctgatcaccgcgaaccccgtggtgaccaagaaggaggagcccgtcaacatcgaggccgagccgcccttcggcgagagcaacatcgtgatcgggatcggcgacaacgccctgaagatcaactggtacaagaaggggtccagcatcggcaagatgttcgaggccaccgcgcgcggggcccgccggatggccatcctgggcgacacggcctgggacttcggctccgtcgggggcgtcctcaacagcctggggaagatggtgcaccagatcttcggctccgcctacaccgcgctgttcagcggggtgtcctgggtcatgaagatcggcatcggcgtgctcctgacctggatcgggctgaacagcaagaacacctccatgagcttctcctgcatcgccatcggcatcatcacgctctacctgggggccgtggtccaggccgacatgggctgcgtgatcaactggaaggggaaggagctgaagtgcggcagcggcatcttcgtgaccaacgaggtccacacctggaccgagcagtacaagttccaggccgactcccccaagcgcctcgcgacggccatcgccggggcctgggagaacggcgtgtgcgggatccgcagcaccacccggatggagaacctgctgtggaagcagatcgccaacgagctcaactacatcctgtgggagaacaacatcaagctgaccgtggtcgtgggcgacatcatcggggtgctcgagcagggcaagcgcacgctgacgccccagccgatggagctgaagtactcctggaagacctggggcaaggcgcggatcgtcaccgccgagacgcagaacagctccttcatcatcgacgggcccaacacccccgagtgccccagcgcctcccgcgcctggaacgtgtgggaggtggaggactacggcttcggggtcttcaccaccaacatctggctcaagctgcgggaggtgtacacccagctgtgcgaccaccgcctcatgagcgcggccgtgaaggacgagcgggccgtccacgccgacatgggctactggatcgagagccagaagaacggctcctggaagctggagaaggccagcctgatcgaggtgaagacgtgcacctggccgaagtcccacaccctctggagcaacggggtgctggagtccgacatgatcatccccaagagcctggcgggccccatctcccagcacaactaccgcccggggtaccacacccagacggccggcccctggcacctcgggaagctggagctggacttcaactactgcgagggcaccaccgtcgtgatcaccgagaactgcggcacgcgggggcccagcctccgcaccaccaccgtgtccggcaagctgatccacgagtggtgctgccggagctgcacgctgcccccgctccgctacatgggggaggacggctgctggtacgggatggagatccggcccatctccgagaaggaggagaacatggtcaagagcctggtgtccgccggcagcggcgaggtggacaacttcaccatgggggtcctgtgcctcgccatcctgttcgaggaggtgatgcgcggcaagttcgggaagaagcacatgatcgccggcgtgttcttcaccttcgtcctgctcctgtccgggcagatcacctggcgggacatggcgcacacgctgatcatgatcggcagcaacgcctccgaccgcatgggcatgggggtgacctacctcgccctgatcgccaccttcaagatccagcccttcctggccctcggcttcttcctgcggaagctgaccagccgcgagaacctcctgctgggggtgggcctcgcgatggccacgaccctgcagctgcccgaggacatcgagcagatggccaacggcatcgccctcgggctgatggcgctgaagctcatcacccagttcgagacctaccagctgtggacggccctgatcagcctgacctgctccaacaccatcttcaccctgacggtcgcctggcggaccgccaccctgatcctcgccggcgtgagcctgctgccggtctgccagtccagctccatgcgcaagaccgactggctccccatgacggtggcggccatgggggtgccgcccctcccgctgttcatcttcagcctcaaggacaccctgaagcgccggtcctggcccctgaacgagggcgtcatggccgtggggctcgtgagcatcctggcctccagcctgctccgcaacgacgtccccatggccggccccctggtggcgggcgggctgctcatcgcctgctacgtgatcaccggcacctccgccgacctgacggtcgagaaggccgccgacgtgacctgggaggaggaggcggagcagaccggggtgagccacaacctgatgatcaccgtcgacgacgacggcaccatgcggatcaaggacgacgagacggagaacatcctcaccgtgctgctgaagaccgccctcctgatcgtgtccgggatcttcccgtacagcatccccgccaccctgctcgtctggcacacgtggcagaagcagacccagcgctccggcgtgctgtgggacgtgcccagcccgcccgagacccagaaggccgagctggaggagggcgtctaccggatcaagcagcaggggatcttcggcaagacccaggtgggggtgggcgtccagaaggagggggtgttccacacgatgtggcacgtgacccgcggcgccgtcctcacctacaacggcaagcggctggagcccaactgggcgtccgtgaagaaggacctgatcagctacgggggcgggtggcgcctctccgcccagtggcagaagggcgaggaggtgcaggtcatcgccgtggagcccgggaagaaccccaagaacttccagaccatgcccggcacgttccagaccaccaccggcgagatcggggccatcgcgctggacttcaagcccggcacgagcgggagccccatcatcaaccgggagggcaagatcgtgggcctgtacgggaacggcgtcgtgaccaagaacgggggctacgtgtccgggatcgcccagaccaacgccgagccggacggccccacccccgagctggaggaggagatgttcaagaagcgcaacctcacgatcatggacctgcaccccggcagcgggaagacccggaagtacctgccggccatcgtccgcgaggccatcaagcggcgcctccggaccctgatcctggcgcccacccgcgtggtggccgccgagatggaggaggccctcaagggcctgcccatccggtaccagacgaccgccaccaagtccgagcacaccgggcgcgagatcgtcgacctgatgtgccacgcgacgttcaccatgcggctcctgagccccgtgcgcgtgccgaactacaacctgatcatcatggacgaggcccacttcaccgaccccgcctccatcgccgcccggggctacatcagcacccgcgtcgggatgggcgaggcggccgccatcttcatgacggccacgccgcccggcaccgcggacgccttcccgcagtccaacgcccccatccaggacgaggagcgcgacatccccgagcggagctggaactccgggaacgagtggatcaccgacttcgccggcaagacggtgtggttcgtgcccagcatcaaggccgggaacgacatcgcgaactgcctccgcaagaacggcaagaaggtcatccagctgtcccggaagaccttcgacaccgagtaccagaagaccaagctgaacgactgggacttcgtggtgacgaccgacatcagcgagatgggggccaacttcaaggccgaccgcgtcatcgacccgcggcgctgcctcaagcccgtgatcctgaccgacggccccgagcgggtgatcctggccggccccatgccggtcaccgccgcgtccgccgcccagcgccgggggcgcgtgggccggaacccccagaaggagaacgaccagtacatcttcaccgggcagcccctcaacaacgacgaggaccacgcccactggacggaggccaagatgctgctggacaacatcaacacccccgagggcatcatcccggccctcttcgagcccgagcgcgagaagtccgccgccatcgacggggagtaccggctgaagggcgagtcccgcaagaccttcgtggagctgatgcggcgcggcgacctccccgtctggctggcccacaaggtggcgagcgaggggatcaagtacaccgaccggaagtggtgcttcgacggccagcgcaacaaccagatcctggaggagaacatggacgtcgagatctggacgaaggagggggagaagaagaagctccggccccgctggctggacgcccgcacctactccgacccgctggccctcaaggagttcaaggacttcgccgccggccgcaagagcatcgcgctggacctggtgaccgagatcggccgcgtgcccacccacctcgcccaccggacgcgcaacgccctggacaacctggtcatgctccacacctccgagcacgggggcaaggcctaccggcacgccgtggaggagctgcccgagaccatggagaccctgctcctgctggggctcatgatcctgctgacgggcggggcgatgctgttcctgatcagcggcaagggcatcgggaagaccagcatcggcctgatctgcgtgatcgcctccagcgggatgctctggatggccgagatcccgctgcagtggatcgcctccgccatcgtcctggagttcttcatgatggtgctcctgatccccgagcccgagaagcagcgcacgccccaggacaaccagctggcgtacgtggtcatcggcatcctcaccctggccgccacgatcgccgccaacgagatggggctgctcgagaccaccaagcgggacctgggcatgagcaaggagccgggcgtggtgtcccccaccagctacctggacgtcgacctccaccccgcgtccgcctggacgctgtacgccgtggccaccaccgtgatcacccccatgctgcgccacacgatcgagaacagcaccgcgaacgtctccctcgccgccatcgccaaccaggccgtggtgctgatggggctggacaagggctggccgatcagcaagatggacctcggggtccccctgctggcgctcggctgctactcccaggtgaaccccctgaccctgaccgccgccgtgctcctgctgatcacgcactacgccatcatcgggcccggcctccaggccaaggcgacccgggaggcccagaagcgcaccgccgccggcatcatgaagaacccgaccgtcgacgggatcatgacgatcgacctggaccccgtgatctacgacagcaagttcgagaagcagctgggccaggtgatgctcctggtcctgtgcgccgtgcagctcctgctgatgcggacctcctgggcgctctgcgaggccctgaccctggccaccgggcccatcacgaccctctgggagggcagccccggcaagttctggaacaccaccatcgccgtgtccatggcgaacatcttccgcgggagctacctggccggcgccgggctggccttctccgtcatgaagtccgtgggcaccgggaagcggggcacgggctcccagggggagaccctcggcgagaagtggaagaagaagctgaaccagctgagccgcaaggagttcgacctctacaagaagtccgggatcaccgaggtggaccggaccgaggccaaggagggcctgaagcgcggggagatcacgcaccacgcggtctcccggggcagcgccaagctgcagtggttcgtggagcgcaacatggtgatcccggagggccgggtcatcgacctcgggtgcggccgcgggggctggtcctactactgcgccgggctgaagaaggtgaccgaggtgcggggctacaccaagggcgggcccggccacgaggagcccgtccccatgagcacctacgggtggaacatcgtgaagctgatgtccggcaaggacgtgttctacctcccgcccgagaagtgcgacacgctgctgtgcgacatcggggagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcggcatgctggtgcggaaccccctgagccgcaactccacgcacgagatgtactggatcagcaacgggaccggcaacatcgtcgcctccgtgaacatggtgagccggctcctgctgaaccgcttcaccatgacccaccggcgcccgacgatcgagaaggacgtcgacctcggggccggcacccggcacgtgaacgcggagcccgagacccccaacatggacgtgatcggcgagcgcatcaagcggatcaaggaggagcacaactccacctggcactacgacgacgagaacccgtacaagacgtgggcctaccacgggagctacgaggtcaaggccaccggctccgccagctccatgatcaacggggtggtcaagctgctgaccaagccctgggacgtggtgcccatggtcacccagatggccatgacggacaccacccccttcggccagcagcgcgtgttcaaggagaaggtggacacccggacgccgcgcagcatgcccgggacccggcgcgtcatgggcatcaccgcggagtggctctggcggaccctgggccgcaacaagaagccccggctgtgcacgcgcgaggagttcaccaagaaggtgcgcaccaacgccgccatgggggccgtgttcaccgaggagaaccagtgggacagcgcgaaggccgccgtcgaggacgaggacttctggaagctcgtggaccgggagcgcgagctgcacaagctgggcaagtgcgggtcctgcgtgtacaacatgatgggcaagcgggagaagaagctcggggagttcggcaaggccaagggcagccgcgccatctggtacatgtggctgggggcgcggtacctggagttcgaggccctcggcttcctgaacgaggaccactggttctcccgcgagaacagctactccggggtcgagggcgaggggctgcacaagctcggctacatcctgcgggacatcagcaagatccccggcggggccatgtacgccgacgacacggccggctgggacacccgcatcaccgaggacgacctgcacaacgaggagaagatcacccagcagatggacccggagcaccggcagctcgcgaacgccatcttcaagctgacctaccagaacaaggtggtgaaggtccagcgccccacgcccaccgggaccgtgatggacatcatctcccggaaggaccagcgcggcagcggccaggtggggacctacggcctgaacacgttcaccaacatggaggcccagctcatccggcagatggagggggagggcgtcctgtccaaggccgacctggagaacccccacctcccggagaagaagatcacccagtggctggagaccaagggggtggagcgcctgaagcggatggccatcagcggcgacgactgcgtggtcaagcccatcgacgaccgcttcgcgaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcccggatctcccagggcgccgggtggagcctccgcgagacggcgtgcctgggcaaggcctacgcccagatgtggtccctgatgtacttccaccgccgggacctccgcctggccagcaacgcgatctgctccgccgtgcccgtccactgggtgccgaccagccggaccacctggtccatccacgcccaccaccagtggatgacgaccgaggacatgctgaccgtgtggaaccgcgtctggatcgaggacaacccctggatggaggacaagacccccgtgacgacctgggagaacgtgccctacctcggcaagcgggaggaccagtggtgcgggagcctgatcggcctgaccagccgcgccacctgggcccagaacatcccgacggcgatccagcaggtccggtccctcatcgggaacgaggagttcctggactacatgcccagcatgaagcgcttccggaaggaggaggagtccgagggcgccatctggtga

SEQ ID NO: 10267 - RNA, 9873 nt, synthetic construct
  misc_feature 1..9873: note = derived and/or modified CDS sequence (opt1) from DENV-3__FJ639817__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccgtcctgccggaggagcaggaccagaactacgtgtgcaagcacacctacgtggaccgggggtggggcaacgggtgcggcctcttcgggaagggctccctggtgacctgcgccaagttccagtgcctggagcccatcgagggcaaggtggtgcagtacgagaacctcaagtacaccgtcatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtcaccttcaagaacgcccacgccaagaagcaggaggtggtggtcctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtgtccgagacccagcacgggaccatcctcatcaaggtcgagtacaagggcgaggacgtgccgtgcaagatccccttcagcaccgaggacgggcagggcaaggcgcacaacggccgcctgatcacggccaaccccgtggtcaccaagaaggaggagcccgtgaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtcggcggggtgctcaacagcctgggcaagatggtgcaccagatcttcgggtccgcgtacacggccctgttcagcggcgtctcctgggtgatgaagatcggcatcggggtgctcctgacctggatcggcctgaacagccgcaacacctccatgagcttctcctgcatcgccatcgggatcatcaccctctacctgggcgccgtcgtgcaggccgacatggggtgcgtgatcaactggaagggcaaggagctgaagtgcggcagcgggatcttcgtcacgaacgaggtgcacacctggaccgagcagtacaagttccaggcggactcccccaagcgcctcgccaccgccatcgccggcgcctgggagaacggggtgtgcggcatccggagcacgacccgcatggagaacctgctgtggaagcagatcgcgaacgagctcaactacatcctgtgggagaacaacatcaagctgaccgtcgtggtgggggacatcatcggcgtcctcgagcagggcaagcggaccctgacgccccagccgatggagctgaagtactcctggaagacctgggggaaggccaagatcgtgaccgccgagacccagaacagctccttcatcatcgacggccccaacacgcccgagtgccccagcgcctcccgcgcgtggaacgtgtgggaggtcgaggactacgggttcggcgtgttcaccaccaacatctggctcaagctgcgggaggtgtacacccagctgtgcgaccaccgcctcatgagcgccgccgtcaaggacgagcgggccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccgcccgggctaccacacccagaccgccgggccctggcacctcggcaagctggagctggacttcaactactgcgagggcacgaccgtggtgatcaccgagaactgcgggacccggggccccagcctccgcacgaccaccgtctccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcggggaggtcgacaacttcacgatgggcgtgctgtgcctcgccatcctgttcgaggaggtgatgcgcgggaagttcggcaagaagcacatgatcgcgggggtcttcttcaccttcgtgctgctcctgtccggccagatcacctggcgggacatggcccacaccctgatcatgatcggcagcaacgcctccgaccgcatggggatgggcgtgacgtacctcgccctgatcgccaccttcaagatccagcccttcctggcgctcgggttcttcctgcggaagctgaccagccgcgagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcggacggccaccctgatcctcgcgggggtcagcctgctgccggtgtgccagtccagctccatgcgcaagaccgactggctccccatgaccgtggccgccatgggcgtgccgcccctcccgctgttcatcttcagcctcaaggacacgctgaagcgccggtcctggcccctgaacgagggggtgatggccgtgggcctcgtcagcatcctggcctccagcctgctccgcaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcggatcaaggacgacgagaccgagaacatcctcacggtgctgctgaagaccgccctcctgatcgtctccggcatcttcccgtacagcatccccgccaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgcggtgctcacctacaacgggaagcggctggagcccaactgggcctccgtgaagaaggacctgatcagctacggcgggggctggcgcctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgggagggcaaggtcgtggggctgtacggcaacggggtggtcacgaagaacggcgggtacgtgtccggcatcgcccagaccaacgccgagccggacggccccacccccgagctggaggaggagatgttcaagaagcgcaacctcaccatcatggacctgcaccccgggagcggcaagacgcggaagtacctgccggccatcgtgcgcgaggcgatcaagcggcgcctccggaccctgatcctggcccccacccgcgtcgtggccgccgagatggaggaggccctcaaggggctgcccatccggtaccagaccacggcgaccaagtccgagcacaccggccgcgagatcgtggacctgatgtgccacgccaccttcacgatgcggctcctgagccccgtccgcgtgccgaactacaacctgatcatcatggacgaggcccacttcaccgaccccgcctccatcgccgcgcgggggtacatcagcacccgcgtgggcatgggcgaggccgccgccatcttcatgaccgcgacgccgcccgggaccgccgacgccttcccgcagtccaacgcccccatccaggacgaggagcgcgacatccccgagcggagctggaactccggcaacgagtggatcaccgacttcgccgggaagaccgtctggttcgtgcccagcatcaaggcgggcaacgacatcgccaactgcctccgcaagaacgggaagaaggtgatccagctgtcccggaagacgttcgacaccgagtaccagaagaccaagctgaacgactgggacttcgtcgtgaccacggacatcagcgagatgggcgccaacttcaaggccgaccgcgtgatcgacccgcggcgctgcctcaagcccgtcatcctgaccgacggccccgagcgggtgatcctggccgggcccatgccggtgaccgcggcctccgccgcccagcgccggggccgcgtcgggcggaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacgtactccgacccgctggccctcaaggagttcaaggacttcgccgcgggccgcaagagcatcgccctggacctggtcaccgagatcgggcgcgtgcccacccacctcgcccaccggacccgcaacgccctggacaacctggtgatgctccacacgtccgagcacggcgggaaggcctaccggcacgcggtcgaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtgctggagttcttcatgatggtcctcctgatccccgagcccgagaagcagcgcacgccccaggacaaccagctggcctacgtggtgatcgggatcctcaccctggccgccatcatcgccgcgaacgagatgggcctgctcgagaccacgaagcgggacctgggcatgagccgcgagccgggggtcgtgtcccccaccagctacctggacgtggacctccaccccgcctccgcctggaccctgtacgccgtcgcgaccacggtgatcacccccatgctgcggcacaccatcgagaacagcaccgccaacgtgtccctcgccgccatcgccaaccaggcggtcgtgctgatgggcctggacaaggggtggccgatcagcaagatggacctcggcgtgcccctgctggccctcgggtgctactcccaggtcaaccccctgacgctgaccgccgccgtgctcctgctgatcacccactacgccatcatcggccccggcctccaggcgaaggccacccgcgaggcccagaagcggacggccgccgggatcatgaagaacccgaccgtggacggcatcatgaccatcgacctggaccccgtcatctacgacagcaagttcgagaagcagctgggccaggtgatgctcctggtgctgtgcgcggtccagctcctgctgatgcgcacctcctgggccctctgcgaggccctgacgctggccaccggccccatcaccaccctctgggagggcagccccgggaagttctggaacacgaccatcgcggtgtccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtcgaccgcaccgaggcgaaggaggggctgaagcggggcgagatcacccaccacgccgtgtcccgcggcagcgccaagctgcagtggttcgtggagcggaacatggtcatcccggaggggcgcgtgatcgacctcggctgcgggcggggcgggtggtcctactactgcgccggcctgaagaaggtgaccgaggtccgcggctacacgaagggcgggcccgggcacgaggagcccgtgcccatgagcacctacggctggaacatcgtgaagctgatgtccgggaaggacgtcttctacctcccgcccgagaagtgcgacaccctgctgtgcgacatcggcgagagctcccccagccccaccgtggaggagtcccgcacgatccgggtgctgaagatggtcgagccgtggctcaagaacaaccagttctgcatcaaggtgctgaacccctacatgcccgccgtgatcgagcacctggagcgcctccagcggaagcacggcgggatgctggtccgcaaccccctgagccggaactccacccacgagatgtactggatcagcaacggcaccgggaacatcgtggcgtccgtgaacatggtcagccgcctcctgctgaaccggttcaccatgacgcaccgccggccgaccatcgagaaggacgtggacctcggcgccggcacccgccacgtgaacgccgagcccgagacccccaacatggacgtcatcggggagcggatcaagcgcatcaaggaggagcacaactccacgtggcactacgacgacgagaacccgtacaagacctgggcctaccacggcagctacgaggtgaaggccaccgggtccgcgagctccatgatcaacggcgtcgtgaagctgctgaccaagccctgggacgtggtccccatggtgacgcagatggccatgaccgacaccacccccttcgggcagcagcgggtgttcaaggagaaggtcgacacgcgcaccccgcggagcatgcccggcacccgccgggtgatgggcatcaccgccgagtggctctggcgcacgctggggcggaacaagaagccccgcctgtgcacccgcgaggagttcaccaagaaggtgcggaccaacgccgcgatgggcgccgtcttcacggaggagaaccagtgggacagcgccaaggccgccgtggaggacgaggacttctggaagctcgtggaccgcgagcgggagctgcacaagctggggaagtgcggctcctgcgtctacaacatgatggggaagcgcgagaagaagctcggcgagttcggcaaggcgaaggggagccgggccatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgcggacgacaccgccgggtgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaccggcaccgtgatggacatcatctcccgcaaggaccagcggggcagcgggcaggtcggcacgtacgggctgaacaccttcaccaacatggaggcccagctcatccgccagatggagggcgagggggtgctgtccaaggcggacctggagaacccccacctcccggagaagaagatcacccagtggctggagacgaagggcgtggagcggctgaagcgcatggccatcagcggcgacgactgcgtcgtgaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtggtgccctgccgcccccaggacgagctgatcggccgggcgcgcatctcccagggggccggctggagcctccgcgagaccgcctgcctgggcaaggcctacgcgcagatgtggtccctgatgtacttccaccggcgcgacctccggctggccagcaacgccatctgctccgccgtccccgtgcactgggtgccgaccagccgcaccacgtggtccatccacgcccaccaccagtggatgaccaccgaggacatgctgaccgtctggaaccgggtgtggatcgaggacaacccctggatggaggacaagacgcccgtgaccacctgggagaacgtcccctacctcgggaagcgcgaggaccagtggtgcggcagcctgatcgggctgaccagccgggcgacgtgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 10268 - RNA, 9873 nt, synthetic construct
  misc_feature 1..9873: note = derived and/or modified CDS sequence (opt1) from DENV-3__FJ639825__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggactacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagcagtgcgaccaccggctgatgagcgccgccgtgaaggacgagcgcgccgtccacgccgacatgggctactggatcgagagccagaagaacgggtcctggaagctcgagaaggcgagcctgatcgaggtgaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtcgtgatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtgtccgccggcagcggggaggtggacaacttcaccatgggcgtcctgtgcctggccatcctcttcgaggaggtgatgcgggggaagttcggcaagaagcacatgatcgcgggggtgttcttcaccttcgtcctgctgctctccggccagatcacctggcgcgacatggcccacacgctgatcatgatcggcagcaacgcctccgaccggatggggatgggcgtgacctacctggccctcatcgccaccttcaagatccagcccttcctggcgctggggttcttcctccgcaagctgaccagccgggagaacctgctcctgggcgtgggcctggccatggccacgaccctccagctgcccgaggacatcgagcagatggccaacgggatcgcgctgggcctcatggccctgaagctgatcacccagttcgagacctaccagctctggacggccctgatcagcctgacctgctccaacaccatcttcaccctcacggtcgcctggcgcaccgccaccctgatcctggcgggggtgagcctcctgccggtctgccagtccagctccatgcggaagaccgactggctgcccatgacggtggccgccatgggcgtgccgcccctcccgctgttcatcttcagcctgaaggacaccctcaagcgccgctcctggcccctgaacgagggggtcatggccgtgggcctggtgagcatcctcgcctccagcctgctgcggaacgacgtccccatggcgggccccctcgtggccgggggcctgctgatcgcctgctacgtgatcaccgggacctccgccgacctcacggtcgagaaggccgcggacgtgacctgggaggaggaggccgagcagaccggcgtgagccacaacctgatgatcaccgtcgacgacgacgggaccatgcgcatcaaggacgacgagacggagaacatcctgaccgtgctcctgaagaccgccctgctcatcgtgtccggcatcttcccgtacagcatccccgccaccctgctggtctggcacacgtggcagaagcagacccagcggtccggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctgacctacaacgggaagcgcctcgagcccaactgggcctccgtgaagaaggacctgatcagctacggcgggggctggcggctgtccgcccagtggcagaagggggaggaggtgcaggtcatcgccgtggagcccggcaagaaccccaagaacttccagaccatgcccggcacgttccagaccaccaccggggagatcggcgcgatcgccctcgacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctgacgatcatggacctccaccccgggagcggcaagacccgcaagtacctgccggccatcgtgcgggaggcgatcaagcgccggctgcgcaccctcatcctggcccccacccgggtggtcgccgccgagatggaggaggccctgaaggggctccccatccgctaccagacgaccgcgaccaagtccgagcacaccggccgggagatcgtggacctgatgtgccacgccacgttcaccatgcgcctgctcagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctgcggaagaacgggaagaaggtgatccagctctcccgcaagaccttcgacaccgagtaccagaagaccaagctgaacgactgggacttcgtggtcacgaccgacatcagcgagatgggcgccaacttcaaggccgaccgggtgatcgacccgcgccggtgcctgaagcccgtgatcctcaccgacggccccgagcgcgtcatcctggccgggcccatgccggtgaccgcggcctccgccgcccagcggcgcggccgggtggggcgcaacccccagaaggagaacgaccagtacatcttcaccggccagcccctgaacaacgacgaggaccacgcccactggacggaggcgaagatgctcctggacaacatcaacacccccgaggggatcatcccggccctgttcgagcccgagcgggagaagtccgccgccatcgacggcgagtaccgcctcaagggcgagtcccggaagaccttcgtcgagctgatgcgccgcggggacctgcccgtgtggctcgcgcacaaggtcgccagcgagggcatcaagtacaccgaccgcaagtggtgcttcgacgggcagcggaacaaccagatcctggaggagaacatggacgtggagatctggacgaaggagggcgagaagaagaagctgcgcccccggtggctcgacgcccgcacctactccgacccgctggccctgaaggagttcaaggacttcgccgcgggccgcaagagcatcgccctcgacctggtgaccgagatcgggcgggtcccctcccacctggcccaccgcacccggaacgccctcgacaacctggtgatgctgcacacgagcgagcacggcgggaaggcctaccgccacgcggtggaggagctccccgagaccatggagaccctgctgctcctgggcctgatgatcctcctgaccgggggcgccatgctgttcctcatcagcggcaaggggatcggcaagacgtccatcgggctgatctgcgtcatcgccagctccggcatgctgtggatggccgagatcccgctccagtggatcgccagcgcgatcgtgctggagttcttcatgatggtgctgctcatccccgagcccgagaagcagcggacgccccaggacaaccagctggcctacgtcgtgatcgggatcctgaccctcgccgccatcatcgccgcgaacgagatgggcctgctggagaccacgaagcgcgacctcggcatgtccaaggagccgggggtggtcagccccacctcctacctggacgtggacctgcaccccgccagcgcctggaccctctacgccgtggcgaccacggtcatcacccccatgctgcggcacaccatcgagaactccaccgccaacgtgagcctggccgccatcgccaaccaggcggtggtcctcatgggcctggacaaggggtggccgatctccaagatggacctgggcgtgcccctcctggccctggggtgctacagccaggtgaaccccctcacgctgaccgccgccgtcctgctcctgatcacccactacgccatcatcggccccggcctgcaggcgaaggccacccgcgaggcccagaagcggacggccgccgggatcatgaagaacccgaccgtggacggcatcatgaccatcgacctcgaccccgtgatctacgactccaagttcgagaagcagctggggcaggtcatgctgctcgtgctgtgcgcggtgcagctgctcctgatgcgcaccagctgggccctgtgcgaggccctcacgctggccaccggccccatcaccaccctgtgggagggctcccccgggaagttctggaacacgaccatcgcggtcagcatggccaacatcttccggggctcctacctcgccggggccggcctggccttcagcatcatgaagtccgtggggaccggcaagcgcggcaccgggagccagggcgagaccctgggggagaagtggaagaagaagctcaaccagctgagccggaaggagttcgacctgtacaagaagtccggcatcacggaggtggaccgcaccgaggcgaaggaggggctcaagcggggcgagatcacccaccacgccgtcagccgcggctccgccaagctgcagtggttcgtggagcggaacatggtgatcccggaggggcgcgtcatcgacctgggctgcgggcggggcgggtggagctactactgcgccggcctcaagaaggtgaccgaggtgcgcggctacacgaagggcgggcccgggcacgaggagcccgtccccatgtccacctacggctggaacatcgtgaagctgatgagcgggaaggacgtgttctacctgccgcccgagaagtgcgacaccctcctgtgcgacatcggcgagtccagcccctcccccaccgtcgaggagagccggacgatccgcgtgctgaagatggtggagccgtggctgaagaacaaccagttctgcatcaaggtcctcaacccctacatgcccaccgtgatcgagcacctggagcgcctgcagcggaagcacggcgggatgctcgtgcgcaaccccctgtcccggaacagcacccacgagatgtactggatctccaacggcaccgggaacatcgtcgccagcgtgaacatggtgtcccgcctgctcctgaaccggttcacgatgacccaccgccggccgaccatcgagaaggacgtcgacctgggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctcctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctgtggcgcaccctcgggcggaacaagaagccccgcctgtgcacccgggaggagttcaccaagaaggtgcgcacgaacgccgccatgggcgcggtgttcaccgaggagaaccagtgggactccgccaaggccgccgtcgaggacgaggacttctggaagctggtggaccgcgagcgggagctccacaagctggggaagtgcggcagctgcgtgtacaacatgatggggaagcgcgagaagaagctgggcgagttcggcaaggccaaggggtcccgggcgatctggtacatgtggctcggcgcccgctacctggagttcgaggccctggggttcctcaacgaggaccactggttcagccgggagaactcctacagcggcgtcgagggggagggcctgcacaagctgggctacatcctccgcgacatctccaagatccccgggggcgccatgtacgccgacgacaccgcggggtgggacacccggatcacggaggacgacctgcacaacgaggagaagatcacccagcagatggacccggagcacaagcagctggccaacgccatcttcaagctcacctaccagaacaaggtggtgaaggtccagcgccccacccccaccggcacggtgatggacatcatcagccggaaggaccagcgcggctccggccaggtgggcacctacgggctgaacaccttcaccaacatggaggcccagctgatccggcagatggagggcgagggggtcctcagcaaggccgacctggagaacccccacctccccgagaagaagatcacgcagtggctggagaccaagggcgtggagcgcctgaagcggatggcgatctccggcgacgactgcgtggtcaagcccatcgacgaccgcttcgccaacgccctgctcgccctgaacgacatggggaaggtgcggaaggacatcccccagtggcagcccagcaagggctggcacgactggcagcaggtcccgttctgctcccaccacttccacgagctgatcatgaaggacgggcgcaagctcgtcgtgccctgccggccccaggacgagctgatcggccgcgcccggatcagccagggggcgggctggtccctgcgcgagaccgcctgcctcggcaaggcctacgcccagatgtggagcctgatgtacttccaccggcgcgacctgcgcctcgcgtccaacgccatctgcagcgccgtgcccgtccactgggtgccgacctcccggacgacctggagcatccacgcccaccaccagtggatgaccaccgaggacatgctgacggtgtggaaccgcgtctggatcgaggacaacccctggatggaggacaagacccccgtgaccacctgggagaacgtgccctacctggggaagcgggaggaccagtggtgcggcagcctcatcgggctgacgtcccgcgccacctgggcgcagaacatcccgaccgccatccagcaggtccggagcctgatcggcaacgaggagttcctcgactacatgccctccatgaagcgcttccggaaggaggaggagagcgagggggccatctggtga

SEQ ID NO: 10269 - RNA, 9873 nt, synthetic construct
  misc_feature 1..9873: note = derived and/or modified CDS sequence (opt1) from DENV-3__FJ639826__SS-prME
  source 1..9873: mol_type = other RNA
accagcctctgcctcatgatgatcctgcccgcggccctggcgttccacctcaccagccgggacggcgagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcccggatcgtcaccgccgagacgcagaacagctccttcatcatcgacggccccaacacccccgagtgccccaacaccagccgcgcctggaacgtgtgggaggtggaggactacgggttcggcgtcttcaccaccaacatctggctcaagctgcgggaggtgtacacgcagctgtgcgaccaccgcctcatgtccgcggccgtgaaggacgagcgggccgtccacgccgacatgggctactggatcgagagccagaagaacgggagctggaagctggagaaggcctccctgatcgaggtgaagacctgcacctggcccaagagccacaccctctggtccaacggcgtgctggagagcgacatgatcatccccaagtccctggcggggcccatcagccagcacaactaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcagcgagaaggaggagaacatggtcaagtccctggtgagcgccggctccggggaggtggacaacttcaccatgggcgtcctgtgcctcgccatcctgttcgaggaggtgatgcgcgggaagttcggcaagaagcacatgatcgccggggtgttcttcaccttcgtcctgctcctgagcggccagatcacgtggcgggacatggcgcacaccctgatcatgatcggctccaacgccaccgaccgcatggggatgggcgtgacctacctcgccctgatcgccacgttcaagatccagcccttcctggccctcgggttcttcctgcggaagctgaccagccgcgagaacctcctgctgggcgtgggcctcgcgatggccaccaccctgcagctgcccgaggacatcgagcagatggccaacgggatcgccctcggcctgatggcgctgaagctcatcacgcagttcgagacctaccagctgtggaccgccctgatctccctgacctgcagcaacacgatcttcaccctgaccgtcgcctggcggaccgccacgctgatcctcgccggggtgagcctgctgccggtctgccagtccagctccatgcgcaagaccgactggctccccatgaccgtggcggccatgggcgtgccgcccctcccgctgttcatcttcagcctcaaggacaccctgaagcgccggtcctggcccctgaacgagggggtcatggccgtgggcctcgtgagcatcctggcctccagcctgctccgcaacgacgtccccatggccggccccctggtggccggcgggctgctcatcgcctgctacgtgatcacggggacctccgccgacctgaccgtcgagaaggccgccgacgtgacctgggaggaggaggcggagcagaccggggtgagccacaacctgatgatcacggtcgacgacgacgggaccatgcggatcaaggacgacgagaccgagaacatcctcaccgtgctgctgaagacggccctcctgatcgtgtccggcatcttcccgtacagcatccccgccaccctgctcgtctggcacacctggcagaagcagacccagcgctccggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcgtccgtgaagaaggacctgatcagctacggcgggggctggcgcctctccgcccagtggcagaagggggaggaggtgcaggtcatcgccgtggagcccggcaagaaccccaagaacttccagaccatgcccggcaccttccagaccacgaccggggagatcggcgccatcgcgctggacttcaagcccgggaccagcggctcccccatcatcaaccgggagggcaaggtggtcgggctgtacggcaacggggtggtgaccaagaacggcgggtacgtcagcggcatcgcccagacgaacgccgagccggacggccccacccccgagctggaggaggagatgttcaagaagcgcaacctcaccatcatggacctgcaccccgggagcggcaagacccggaagtacctgccggccatcgtgcgcgaggccatcaagcggcgcctccggacgctgatcctggcgcccacccgcgtggtcgccgccgagatggaggaggccctcaaggggctgcccatccggtaccagaccaccgccacgaagtccgagcacaccggccgcgagatcgtggacctgatgtgccacgcgaccttcaccatgcggctcctgagccccgtgcgcgtcccgaactacaacctgatcatcatggacgaggcccacttcacggaccccgcctccatcgccgcccgggggtacatcagcacccgcgtgggcatgggcgaggcggccgccatcttcatgaccgccacgccgcccgggacggcggacgccttcccgcagtccaacgcccccatccaggacgaggagcgcgacatccccgagcggagctggaactccggcaacgagtggatcaccgacttcaccgggaagaccgtgtggttcgtccccagcatcaaggccggcaacgacatcgccaactgcctccgcaagaacgggaagaaggtgatccagctgtcccggaagacgttcgacaccgagtaccagaagaccaagctgaacgactgggacttcgtggtcaccaccgacatcagcgagatgggcgcgaacttcaaggccgaccgcgtgatcgacccgcggcgctgcctcaagcccgtgatcctgacggacggccccgagcgggtcatcctggccgggcccatgccggtgaccgccgcctccgcggcccagcgccggggccgcgtggggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccggctgaagggcgagtcccgcaagaccttcgtcgagctgatgcggcgcggggacctccccgtgtggctggcccacaaggtcgccagcgagggcatcaagtacaccgaccggaagtggtgcttcgacgggcagcgcaacaaccagatcctggaggagaacatggacgtggagatctggaccaaggagggcgagaagaagaagctccggccccgctggctggacgcgcgcacgtactccgacccgctggccctcaaggagttcaaggacttcgccgccggccgcaagagcatcgccctggacctggtgaccgagatcgggcgcgtccccacccacctcgcgcaccggacccgcaacgccctggacaacctggtgatgctccacacgtccgagcacggcgggaaggcctaccggcacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgcgagcagcggcatgctctggatggccgagatcccgctgcagtggatcgcctccgccatcgtgctggagttcttcatgatggtgctcctgatccccgagcccgagaagcagcgcacgccccaggacaaccagctggcctacgtcgtgatcgggatcctcaccctggcggccatcatcgccgccaacgagatgggcctgctcgagaccacgaagcgggacctgggcatgagcaaggagccgggggtggtctcccccaccagctacctggacgtggacctccaccccgcctccgcgtggaccctgtacgccgtggccaccacggtcatcacccccatgctgcgccacaccatcgagaacagcaccgccaacgtgtccctcgcggccatcgccaaccaggccgtggtcctgatgggcctggacaaggggtggccgatcagcaagatggacctcggcgtgcccctgctggccctcgggtgctactcccaggtgaaccccctgacgctgaccgcggccgtcctcctgctgatcacccactacgccatcatcggccccggcctccaggccaaggccacccgggaggcgcagaagcgcacggccgccgggatcatgaagaacccgaccgtggacggcatcatgaccatcgacctggaccccgtgatctacgacagcaagttcgagaagcagctggggcaggtcatgctcctggtgctgtgcgccgtgcagctcctgctgatgcggacctcctgggccctctgcgaggcgctgacgctggccaccggccccatcaccaccctctgggagggcagccccgggaagttctggaacaccacgatcgccgtctccatggccaacatcttccgcggcagctacctggcgggggccggcctggccttctccatcatgaagtccgtggggaccggcaagcggggcaccgggtcccagggcgagaccctcggggagaagtggaagaagaagctgaaccagctgagccgcaaggagttcgacctctacaagaagtccggcatcacggaggtggaccggaccgaggccaaggaggggctgaagcgcggcgagatcacccaccacgccgtcagccggggcagcgcgaagctgcagtggttcgtggagcgcaacatggtgatcccggaggggcgggtcatcgacctcggctgcgggcgcggcgggtggtcctactactgcgccggcctgaagaaggtgaccgaggtgcggggctacacgaagggcggccccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccgcacgatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgagccgcaactccacccacgagatgtactggatcagcaacggcaccgggaacatcgtcgcctccgtgaacatggtgagccggctcctgctgaaccgcttcaccatgacgcaccggcgcccgaccatcgagaaggacgtcgacctcggcgccggcacccggcacgtgaacgcggagcccgagacccccaacatggacgtgatcggggagcgcatcaagcggatcaaggaggagcacaactccacgtggcactacgacgacgagaacccgtacaagacctgggcctaccacggcagctacgaggtcaaggccaccgggtccgccagctccatgatcaacggcgtggtcaagctgctgaccaagccctgggacgtggtgcccatggtcacgcagatggccatgaccgacaccacccccttcgggcagcagcgcgtgttcaaggagaaggtggacacgcggaccccgcgcagcatgcccggcacccggcgcgtcatggagatcaccgcggagtggctctggcggacgctgggccgcaacaagaagccccggctgtgcacccgcgaggagttcaccaagaaggtgcgcaccaacgccgccatgggggccgtgttcacggaggagaaccagtgggactccgcgaaggccgccgtcgaggacgaggacttctggaagctcgtggaccgggagcgcgagctgcacaagctgggcaagtgcgggagctgcgtgtacaacatgatgggcaagcgggagaagaagctcggggagttcggcaaggccaagggcagccgcgccatctggtacatgtggctgggggcgcggtacctggagttcgaggccctcggcttcctgaacgaggaccactggttctcccgcgagaacagctactccggggtcgagggcgaggggctgcacaagctcggctacatcctgcgggacatcagcaagatccccggcggggccatgtacgccgacgacaccgccggctgggacacccgcatcaccgaggacgacctgcacaacgaggagaagatcacccagcagatggacccggagcaccggcagctcgcgaacgccatcttcaagctgacgtaccagaacaaggtggtgaaggtccagcgccccacccccaccgggaccgtgatggacatcatctcccggaaggaccagcgcggcagcggccaggtggggacgtacggcctgaacaccttcaccaacatggaggcccagctcatccggcagatggagggggagggcgtcctgtccaaggccgacctggagaacccccacctcccggagaagaagatcacccagtggctggagacgaagggggtggagcgcctgaagcggatggccatcagcggcgacgactgcgtggtcaagcccatcgacgaccgcttcgcgaacgccctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtcgtgccctgccggccccaggacgagctgatcgggcgcgcccggatctcccagggcgccgggtggagcctccgcgagaccgcgtgcctgggcaaggcctacgcccagatgtggtccctgatgtacttccaccgccgggacctccgcctggccagcaacgcgatctgctccgccgtgcccgtccactgggtgccgaccagccggaccacgtggtccatccacgcccaccaccagtggatgaccaccgaggacatgctgaccgtgtggaaccgcgtctggatcgaggacaacccctggatggaggacaagacgcccgtgaccacctgggagaacgtgccctacctcggcaagcgggaggaccagtggtgcgggagcctgatcggcctgacctcccgcgccacgtgggcccagaacatcccgaccgcgatccagcaggtccggagcctcatcgggaacgaggagttcctggactacatgcccagcatgaagcgcttccggaaggaggaggagtccgagggcgccatctggtga

SEQ ID NO: 10270 - RNA, 9873 nt, synthetic construct
  misc_feature 1..9873: note = derived and/or modified CDS sequence (opt1) from DENV-3__FJ810416__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctgatgaccgagatcgggcgggtgccctcccacctcgcccaccgcacccggaacgccctggacaacctggtcatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccaccaagcgcgacctgggcatgtccaaggagccgggggtggtgagccccacgtcctacctggacgtcgacctccaccccgccagcgcctggaccctgtacgccgtggcgaccaccgtgatcacgcccatgctgcggcacaccatcgagaactccaccgccaacgtcagcctcgccgccatcgccaaccaggcggtggtgctgatgggcctggacaaggggtggccgatctccaagatggacctcggcgtccccctgctggccctcgggtgctacagccaggtgaaccccctgaccctgacggccgccgtgctcctgctgatcacccactacgccatcatcggccccggcctccaggcgaaggccacccgcgaggcccagaagcggaccgccgccgggatcatgaagaacccgacggtcgacggcatcatgaccatcgacctggaccccgtgatctacgactccaagttcgagaagcagctgggccaggtgatgctcctggtcctgtgcgcggtgcagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtcgggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccggaccatccgcgtcctgaagatggtggagccgtggctcaagaacaaccagttctgcatcaaggtgctgaacccctacatgcccacggtcgtggagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccggctcccggagaagaagatcacccagtggctggagacgaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccatcaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10271 - RNA, 9873 nt, synthetic construct
  misc_feature 1..9873: note = derived and/or modified CDS sequence (opt1) from DENV-3__GQ252678__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacccacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatctcccgcaaggaccagcggggcagcggccaggtgggcacctacgggctgaacaccttcaccaacatggaggcccagctcatccgccagatggagggcgagggggtcctgtccaaggccgacctggagaacccccacctcccggagaagaagatcacgcagtggctggagaccaagggcgtggagcggctgaagcgcatggcgatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtccactgggtgccgaccagccgcacgacctggtccatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgagccgggccacctgggcgcagaacatctccaccgccatccagcaggtccgcagcctcatcggcaacgaggagttcctggactacatgccgtccatgaagcggttccgcaaggaggaggagagcgagggggccatctggtga

SEQ ID NO: 10272 - RNA, 9873 nt, synthetic construct
  misc_feature 1..9873: note = derived and/or modified CDS sequence (opt1) from DENV-3__FJ850098__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgcccgaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggaccccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacgtgatcggcgtcctcgagcagggcaagcgcaccctgacgctgcagcccatggagctcaagtactcctggaagacctgggggaaggccaagatcgtgaccgccgagacccagaacagctccttcatcatcgacggcccgaacacgcccgagtgccccagcgcctcccgggcgtggaacgtgtgggaggtcgaggactacgggttcggcgtgttcaccaccaacatctggctgaagctgcgcgaggtgtacacccagctctgcgaccaccggctgatgagcgccgccgtcaaggacgagcgcgccgtgcacgccgacatgggctactggatcgagagccagaagaacgggtcctggaagctggagaaggcgagcctcatcgaggtgaagacctgcacgtggcccaagtcccacaccctgtggagcaacggcgtcctggagtccgacatgatcatccccaagagcctcgccgggcccatctcccagcacaactaccggcccggctaccacacccagaccgccgggccgtggcacctgggcaagctggagctcgacttcaactactgcgagggcacgaccgtggtgatcaccgagaactgcgggacccgcggccccagcctgcggacgaccaccgtctccgggaagctgatccacgagtggtgctgccgcagctgcaccctgccgcccctccggtacatgggcgaggacgggtgctggtacggcatggagatccgcccgatctccgagaaggaggagaacatggtcaagagcctggtgtccgccggcagcggggaggtcgacaacttcacgatgggcgtgctctgcctggccatcctgttcgaggaggtgatgcgggggaagttcggcaagaagcacatgatcgcgggggtcttcttcaccttcgtgctcctgctgtccggccagatcacctggcgcgacatggcccacaccctcatcatgatcggcagcaacgcctccgaccggatggggatgggcgtgacgtacctggccctgatcgccaccttcaagatccagcccttcctcgcgctggggttcttcctgcgcaagctcaccagccgggagaacctgctgctcggcgtcggcctggccatggccaccacgctgcagctccccgaggacatcgagcagatggccaacgggatcgcgctgggcctgatggccctcaagctgatcacccagttcgagacctaccagctgtggaccgccctcatcagcctgacgtgctccaacaccatcttcaccctgaccgtggcctggcgcacggccaccctcatcctggcgggggtcagcctgctccccgtgtgccagtccagctccatgcggaagaccgactggctgccgatgaccgtggccgccatgggcgtgccgcccctgcccctcttcatcttcagcctgaaggacacgctgaagcgccgctcctggccgctcaacgagggggtgatggccgtgggcctggtcagcatcctggcctccagcctcctgcggaacgacgtgcccatggcgggccccctggtggccgggggcctcctgatcgcctgctacgtcatcaccgggacctccgccgacctgaccgtggagaaggccgcggacgtgacgtgggaggaggaggccgagcagaccggcgtcagccacaacctcatgatcaccgtggacgacgacgggaccatgcgcatcaaggacgacgagaccgagaacatcctgacggtgctgctcaagaccgccctgctgatcgtctccggcatcttcccctacagcatcccggccaccctcctggtgtggcacacctggcagaagcagacgcagcggtccggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacaccatgtggcacgtcacgcggggcgcggtgctgacctacaacgggaagcgcctggagccgaactgggcctccgtgaagaaggacctcatcagctacggcgggggctggcggctgtccgcccagtggcagaagggggaggaggtccaggtgatcgccgtggagcccggcaagaaccccaagaacttccagaccatgcccggcaccttccagacgaccaccggggagatcggcgcgatcgccctggacttcaagccggggaccagcggcagccccatcatcaaccgcgagggcaaggtcgtggggctgtacggcaacggggtggtcacgaagaacggcgggtacgtgtccggcatcgcccagaccaacgccgagcccgacggcccgacccccgagctcgaggaggagatgttcaagaagcggaacctgaccatcatggacctgcaccccgggagcggcaagacgcgcaagtacctccccgccatcgtgcgggaggcgatcaagcgccggctgcgcaccctgatcctcgccccgacccgggtcgtggccgccgagatggaggaggccctgaaggggctgcccatccgctaccagaccacggcgaccaagtccgagcacaccggccgggagatcgtggacctcatgtgccacgccaccttcacgatgcgcctgctgagccccgtccgggtgcccaactacaacctcatcatcatggacgaggcccacttcaccgacccggcctccatcgccgcgcgcgggtacatcagcacccgggtgggcatgggcgaggccgccgccatcttcatgaccgcgacgccgcccgggaccgccgacgccttcccccagtccaacgccccgatccaggacgaggagcgcgacatccccgagcgcagctggaactccggcaacgagtggatcaccgacttcgccgggaagaccgtctggttcgtgcccagcatcaaggcgggcaacgacatcgccaactgcctgcggaagaacgggaagaaggtgatccagctgtcccgcaagacgttcgacaccgagtaccagaagaccaagctcaacgactgggacttcgtcgtgaccacggacatcagcgagatgggcgccaacttcaaggccgaccgggtgatcgacccccgccggtgcctgaagccggtcatcctgaccgacggccccgagcgcgtgatcctcgccgggcccatgcccgtgaccgcggcctccgccgcccagcggcgcggccgggtcgggcgcaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgggagaagtccgccgccatcgacggcgagtaccgcctgaagggcgagtcccggaagaccttcgtggagctcatgcgccgcggggacctgcccgtctggctggcgcacaaggtggccagcgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacgtactccgaccccctcgccctgaaggagttcaaggacttcgccgcgggccgcaagagcatcgccctggacctcgtcaccgagatcgggcgggtgccgtcccacctggcccaccgcacccggaacgccctggacaacctcgtgatgctgcacaccagcgagcacggcgggaaggcctaccgccacgcggtcgaggagctgcccgagacgatggagaccctcctgctgctcggcctgatgatcctgctcaccgggggcgccatgctgttcctgatcagcggcaaggggatcggcaagacctccatcgggctcatctgcgtgatcgccagctccggcatgctgtggatggccgagatccccctgcagtggatcgccagcgcgatcgtgctcgagttcttcatgatggtcctgctgatcccggagcccgagaagcagcggacgccccaggacaaccagctcgcctacgtggtgatcgggatcctgaccctggccgccatcatcgccgcgaacgagatgggcctcctggagaccaccaagcgcgacctgggcatgtccaaggagcccggggtcgtgagcccgacgtcctacctcgacgtggacctgcaccccgccagcgcctggaccctgtacgccgtcgcgaccaccgtgatcacgcccatgctccggcacaccatcgagaactccaccgccaacgtgagcctggccgccatcgccaaccaggcggtcgtgctgatgggcctcgacaaggggtggcccatctccaagatggacctgggcgtgccgctgctcgccctggggtgctacagccaggtcaaccccctgaccctcacggccgccgtgctgctgctcatcacccactacgccatcatcggccccggcctgcaggcgaaggccacccgcgaggcccagaagcggaccgccgccgggatcatgaagaaccccacggtggacggcatcatgaccatcgacctggacccggtcatctacgactccaagttcgagaagcagctcggccaggtgatgctgctggtgctctgcgcggtccagctgctgctcatgcgcaccagctgggccctgtgcgaggccctgaccctcgccacgggccccatcaccaccctgtgggagggctcccccgggaagttctggaacaccacgatcgcggtgagcatggccaacatcttccggggctcctacctggccggggccggcctcgccttcagcatcatgaagtccgtggggaccggcaagcgcggcaccgggagccagggcgagaccctgggggagaagtggaagaagaagctgaaccagctcagccggaaggagttcgacctgtacaagaagtccggcatcaccgaggtcgaccgcacggaggcgaaggaggggctgaagcggggcgagatcacccaccacgccgtgagccgcggctccgccaagctccagtggttcgtggagcggaacatggtcatccccgaggggcgcgtgatcgacctgggctgcgggcggggcgggtggagctactactgcgccggcctgaagaaggtgaccgaggtccgcggctacaccaagggcgggccggggcacgaggagcccgtgcccatgtccacgtacggctggaacatcgtgaagctcatgagcgggaaggacgtcttctacctgcccccggagaagtgcgacaccctgctgtgcgacatcggcgagtccagcccctcccccaccgtggaggagagccggaccatccgcgtgctcaagatggtcgagccctggctgaagaacaaccagttctgcatcaaggtgctgaacccgtacatgcccacggtggtcgagcacctcgagcgcctgcagcggaagcacggcgggatgctggtgcgcaaccccctctcccggaacagcacccacgagatgtactggatctccaacggcaccgggaacatcgtggccagcgtcaacatggtgtcccgcctgctgctcaaccggttcaccatgacgcaccgccggcccaccatcgagaaggacgtggacctgggcgcgggcacccgccacgtcaacgccgagccggagacccccaacatggacgtgatcggggagcggatcaagcgcatcaaggaggagcacaacagcacgtggcactacgacgacgagaacccctacaagacctgggcctaccacggctcctacgaggtcaaggccaccgggagcgcctccagcatgatcaacggcgtggtgaagctgctcaccaagccgtgggacgtcgtgcccatggtgacgcagatggcgatgaccgacaccacccccttcgggcagcagcgggtcttcaaggagaaggtggacacgcgcacgccccggagcatgccgggcacccgccgggtgatgggcatcaccgccgagtggctgtggcgcaccctggggcggaacaagaagccccgcctctgcacccgggaggagttcaccaagaaggtccgcaccaacgccgccatgggcgcggtgttcacggaggagaaccagtgggactccgccaaggccgccgtggaggacgaggacttctggaagctggtcgaccgcgagcgggagctgcacaagctcgggaagtgcggcagctgcgtgtacaacatgatggggaagcgcgagaagaagctgggcgagttcggcaaggccaaggggtcccgggcgatctggtacatgtggctgggcgcccgctacctcgagttcgaggccctggggttcctgaacgaggaccactggttcagccgggagaactcctacagcggcgtggagggggagggcctccacaagctgggctacatcctgcgcgacatctccaagatccccgggggcgccatgtacgccgacgacaccgcggggtgggacacccggatcaccgaggacgacctccacaacgaggagaagatcacgcagcagatggaccccgagcaccgccagctggccaacgccatcttcaagctgacctaccagaacaaggtcgtgaaggtgcagcggccgacccccaccggcaccgtcatggacatcatcagccgcaaggaccagcggggctccggccaggtgggcacgtacgggctcaacaccttcaccaacatggaggcccagctgatccgccagatggagggcgagggggtgctgagcaaggccgacctcgagaacccccggctgcccgagaagaagatcacccagtggctggagacgaagggcgtcgagcgcctcaagcggatggcgatctccggcgacgactgcgtggtgaagccgatcgacgaccgcttcgccaacgccctgctggccctcaacgacatggggaaggtccggaaggacatcccccagtggcagcccagcaagggctggcacgactggcagcaggtccccttctgctcccaccacttccacgagctgatcatgaaggacgggcgcaagctggtggtcccgtgccggccccaggacgagctcatcggccgcgcccggatcagccagggggcgggctggtccctgcgcgagaccgcctgcctgggcaaggcctacgcccagatgtggagcctcatgtacttccaccgccgggacctgcgcctggcgtccaacgccatctgcagcgccgtgcccgtgcactgggtccccacctcccggaccacgtggagcatccacgcccaccaccagtggatgaccaccgaggacatgctcaccgtgtggaaccgcgtgtggatcgaggacaacccgtggatggaggacaagacgcccgtcaccacctgggagaacgtgccctacctggggaagcgggaggaccagtggtgcggcagcctgatcgggctcacctcccgcgccacgtgggcgcagaacatccccaccgccatccagcaggtccggagcctgatcggcaacgaggagttcctggactacatgccgtccatgaagcgcttccggaaggaggaggagagcgagggggccatctggtga

SEQ ID NO: 10273 - RNA, 9873 nt, synthetic construct
  misc_feature 1..9873: note = derived and/or modified CDS sequence (opt1) from DENV-3__KF955479__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcttcatcgaggtgaagacctgcacgtggccgaagtcccacaccctgtggagcaacggcgtgctcgagtccgacatgatcatccccaagagcctggccgggcccatctcccagcacaactaccggccgggctaccacacccagaccgccgggccctggcacctgggcaagctcgagctggacttcaactactgcgagggcacgaccgtcgtgatcaccgagaactgcgggacccgcggccccagcctgcggacgaccaccgtgtccgggaagctcatccacgagtggtgctgccgcagctgcaccctgcccccgctgcggtacatgggcgaggacgggtgctggtacggcatggagatccgccccatctccgagaaggaggagaacatggtcaagagcctcgtgtccgccggcagcggggaggtggacaacttcacgatgggcgtcctgtgcctggccatcctcttcgaggaggtgatgcgggggaagttcggcaagaagcacatgatcgcgggggtgttcttcaccttcgtcctgctgctctccggccagatcacctggcgcgacatggcccacaccctgatcatgatcggcagcaacgcctccgaccggatggggatgggcgtgacgtacctggccctcatcgccaccttcaagatccagcccttcctggcgctggggttcttcctccgcaagctgaccagccgggagaacctgctcctgggcgtgggcctggccatggccaccacgctccagctgcccgaggacatcgagcagatggccaacgggatcgcgctgggcctcatggccctgaagctgatcacccagttcgagacctaccagctctggaccgccctgatcagcctgacgtgctccaacaccatcttcaccctcaccgtcgcctggcgcacggccaccctgatcctggcgggggtgagcctcctgccggtctgccagtccagctccatgcggaagaccgactggctgcccatgaccgtggccgccatgggcgtgccgcccctcccgctgttcatcttcagcctgaaggacacgctcaagcgccgctcctggcccctgaacgagggggtcatggccgtgggcctggtgagcatcctcgcctccagcctgctgcggaacgacgtccccatggcgggccccctcgtggccgggggcctgctgatcgcctgctacgtgatcaccgggacctccgccgacctcaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctgacggtgctcctgaagaccgccctgctcatcgtgtccggcatcttcccgtacagcatccccgccaccctgctggtctggcacacctggcagaagcagacgcagcggtccggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctgacctacaacgggaagcgcctcgagcccaactgggcctccgtgaagaaggacctgatcagctacggcgggggctggcggctgtccgcccagtggcagaagggggaggaggtgcaggtcatcgccgtggagcccggcaagaaccccaagaacttccagaccatgcccggcaccttccagacgaccaccggggagatcggcgcgatcgccctcgacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctgaccatcatggacctccaccccgggagcggcaagacgcgcaagtacctgccggccatcgtgcgggaggcgatcaagcgccggctgcgcaccctcatcctggcccccacccgggtggtcgccgccgagatggaggaggccctgaaggggctccccatccgctaccagaccacggcgaccaagtccgagcacaccggccgggagatcgtggacctgatgtgccacgccaccttcacgatgcgcctgctcagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctgcggaagaacgggaagaaggtgatccagctctcccgcaagacgttcgacaccgagtaccagaagaccaagctgaacgactgggacttcgtggtcaccacggacatcagcgagatgggcgccaacttcaaggccgaccgggtgatcgacccgcgccggtgcctgaagcccgtgatcctcaccgacggccccgagcgcgtcatcctggccgggcccatgccggtgaccgcggcctccgccgcccagcggcgcggccgggtggggcgcaacccccagaaggagaacgaccagtacatcttcaccggccagcccctgaacaacgacgaggaccacgcccactggaccgaggcgaagatgctcctggacaacatcaacacgcccgaggggatcatcccggccctgttcgagcccgagcgggagaagtccgccgccatcgacggcgagtaccgcctcaagggcgagtcccggaagaccttcgtcgagctgatgcgccgcggggacctgcccgtgtggctcgcgcacaaggtcgccagcgagggcatcaagtacaccgaccgcaagtggtgcttcgacgggcagcggaacaaccagatcctggaggagaacatggacgtggagatctggaccaaggagggcgagaagaagaagctgcgcccccggtggctcgacgcccgcacgtactccgacccgctggccctgaaggagttcaaggacttcgccgcgggccgcaagagcatcgccctcgacctggtgaccgagatcgggcgggtcccctcccacctggcccaccgcacccggaacgccctcgacaacctggtgatgctgcacaccagcgagcacggcgggaaggcctaccgccacgcggtggaggagctccccgagacgatggagaccctgctgctcctgggcctgatgatcctcctgaccgggggcgccatgctgttcctcatcagcggcaaggggatcggcaagacctccatcgggctgatctgcgtcatcgccagctccggcatgctgtggatggccgagatcccgctccagtggatcgccagcgcgatcgtgctggagttcttcatgatggtgctgctcatccccgagcccgagaagcagcggacgccccaggacaaccagctggcctacgtcgtgatcgggatcctgaccctcgccgccatcatcgccgcgaacgagatgggcctgctggagaccaccaagcgcgacctcggcatgtccaaggagccgggggtggtcagccccacgtcctacctggacgtggacctgcaccccgccagcgcctggaccctctacgccgtggcgaccaccgtcatcacgcccatgctgcggcacaccatcgagaactccaccgccaacgtgagcctggccgccatcgccaaccaggcggtggtcctcatgggcctggacaaggggtggccgatctccaagatggacctgggcgtgcccctcctggccctggggtgctacagccaggtgaaccccctcaccctgacggccgccgtcctgctcctgatcacccactacgccatcatcggccccggcctgcaggcgaaggccacccgcgaggcccagaagcggaccgccgccgggatcatgaagaacccgacggtggacggcatcatgaccatcgacctcgaccccgtgatctacgactccaagttcgagaagcagctggggcaggtcatgctgctcgtgctgtgcgcggtgcagctgctcctgatgcgcaccagctgggccctgtgcgaggccctcaccctggccacgggccccatcaccaccctgtgggagggctcccccgggaagttctggaacaccacgatcgcggtcagcatggccaacatcttccggggctcctacctcgccggggccggcctggccttcagcatcatgaagtccgtggggaccggcaagcgcggcaccgggagccagggcgagaccctgggggagaagtggaagaagaagctcaaccagctgagccggaaggagttcgacctgtacaagaagtccggcatcaccgaggtggaccgcacggaggcgaaggaggggctcaagcggggcgagatcacccaccacgccgtcagccgcggctccgccaagctgcagtggttcgtggagcggaacatggtgatcccggaggggcgcgtcatcgacctgggctgcgggcggggcgggtggagctactactgcgccggcctcaagaaggtgaccgaggtgcgcggctacaccaagggcgggcccgggcacgaggagcccgtccccatgtccacgtacggctggaacatcgtgaagctgatgagcgggaaggacgtgttctacctgccgcccgagaagtgcgacaccctcctgtgcgacatcggcgagtccagcccctcccccaccgtcgaggagagccggaccatccgcgtgctgaagatggtggagccgtggctgaagaacaaccagttctgcatcaaggtcctcaacccctacatgcccacggtgatcgagcacctggagcgcctgcagcggaagcacggcgggatgctcgtgcgcaaccccctgtcccggaacagcacccacgagatgtactggatctccaacggcaccgggaacatcgtcgccagcgtgaacatggtgtcccgcctgctcctgaaccggttcaccatgacgcaccgccggccgaccatcgagaaggacgtcgacctgggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctcctgaccaagccctgggacgtggtgcccatcgtcacgcagatggcgatgaccgacaccacccccttcgggcagcagcgggtgttcaaggagaaggtggacacgcgcaccccgcggagcatgcccggcacccgccgggtcatgggcatcaccgccgagtggctgtggcgcacgctcgggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctggtggaccgcgagcgggagctccacaagctggggaagtgcggcagctgcgtgtacaacatgatggggaagcgcgagaagaagctgggcgagttcggcaaggccaaggggtcccgggcgatctggtacatgtggctcggcgcccgctacctggagttcgaggccctggggttcctcaacgaggaccactggttcagccgggagaactcctacagcggcgtcgagggggagggcctgcacaagctgggctacatcctccgcgacatctccaagatccccgggggcgccatgtacgccgacgacaccgcggggtgggacacccggatcaccgaggacgacctgcacaacgaggagaagatcacgcagcagatggacccggagcaccgccagctggccaacgccatcttcaagctcacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctgatccgccagatggagggcgagggggtcctcagcaaggccgacctggagaacccccacctccccgagaagaagatcacccagtggctggagacgaagggcgtggagcggctgaagcgcatggcgatctccggcgacgactgcgtggtcaagcccatcgacgaccggttcgccaacgccctgctcgccctgaacgacatggggaaggtgcgcaaggacatcccccagtggcagcccagcaagggctggcacgactggcagcaggtcccgttctgctcccaccacttccacgagctgatcatgaaggacgggcggaagctcgtcgtgccctgccgcccccaggacgagctgatcggccgggcccgcatcagccagggggcgggctggtccctgcgggagaccgcctgcctcggcaaggcctacgcccagatgtggagcctgatgtacttccaccgccgcgacctgcggctcgcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctggggaagcgcgaggaccagtggtgcggcagcctcatcgggctgacctcccgggccacgtgggcgcagaacatcccgaccgccatccagcaggtccgcagcctgatcggcaacgaggagttcctcgactacatgccctccatgaagcggttccgcaaggaggaggagagcgagggggccatctggtga

SEQ ID NO: 10274 - RNA, 9873 nt, synthetic construct
  misc_feature 1..9873: note = derived and/or modified CDS sequence (opt1) from DENV-3__FJ850109__SS-prME
  source 1..9873: mol_type = other RNA
accagcctgtgcctcatgatgatcctgcccgccgccctggcgttccacctcacctcccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacaccggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaactccctgaagatcaactggtacaagaagggcagctccatcgggaagatgttcgaggccaccgcgcggggcgcccgccggatggccatcctgggcgacacggcctgggacttcgggagcgtgggcggggtcctcaactccctgggcaagatggtgcaccagatcttcgggagcgcctacaccgcgctgttctccggcgtgagctgggtcatgaagatcggcatcggggtgctcctgacctggatcggcctgaactccaagaacaccagcatgtccttcagctgcatcgccatcgggatcatcacgctctacctgggcgccgtggtccaggccgacaccgggtgcgtgatcaactggaagggcaaggagctgaagtgcggctccgggatcttcgtgaccaacgaggtccacacctggacggagcagtacaagttccaggccgacagccccaagcgcctcgcgaccgccatcgccggcgcctgggagaacggggtgtgcggcatccgctccaccacccggatggagaacctgctgtggaagcagatcgccaacgagctcaactacatcctgtgggagaacaacatcaagctgacggtggtcgtgggggacatcatcggcgtgctcgagcagggcaagcgcaccctgacgccccagccgatggagctgaagtacagctggaagacctgggggaaggcgcggatcgtcacggccgagacccagaactccagcttcatcatcgacggccccaacacccccgagtgccccaacacctcccgcgcctggaacgtgtgggaggtggaggactacgggttcggcgtcttcaccacgaacatctggctcaagctgcgggaggtgtacacccagctgtgcgaccaccgcctcatgagcgccgcggtgaaggacgagcgggccgtccacgccgacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccgcccgggctaccacacccagaccgcggggccctggcacctcggcaagctggagctggacttcaactactgcgagggcaccacggtcgtgatcaccgagaactgcgggacccggggccccagcctccgcaccacgaccgtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcggggaggtggacaacttcaccatgggcgtcctgtgcctcgccatcctgttcgaggaggtgatgcgcgggaagttcggcaagaagcacatgatcgccggggtgttcttcacgttcgtcctgctcctgtccggccagatcacctggcgggacatggcccacaccctgatcatgatcggcagcaacgcgaccgaccgcatggggatgggcgtgacgtacctcgccctgatcgccaccttcaagatccagcccttcctggccctcgggttcttcctgcggaagctgacctcccgcgagaacctcctgctgggcgtgggcctcgccatggcgaccacgctgcagctgcccgaggacatcgagcagatggccaacgggatcgccctcggcctgatggccctgaagctcatcacccagttcgagacctaccagctgtggaccgcgctgatcagcctcacgtgcagcaacaccatcttcaccctgaccgtcgcctggcggacggccaccctgatcctcgccggggtgtccctgctgccggtctgccagagctccagcatgcgcaagaccgactggctccccatgaccgtggccgcgatgggcgtgccgcccctcccgctgttcatcttctccctcaaggacacgctgaagcgccggagctggcccctgaacgagggggtcatggccgtgggcctcgtgtccatcctggccagctccctgctccgcaacgacgtccccatggccggccccctggtggccgggggcctgctcatcgcgtgctacgtgatcaccgggaccagcgccgacctgaccgtcgagaaggccgccgacgtgacctgggaggaggaggccgagcagacgggcgtgtcccacaacctgatgatcaccgtcgacgacgacgggaccatgcggatcaaggacgacgagaccgagaacatcctcacggtgctgctgaagaccgcgctcctgatcgtgagcggcatcttcccgtactccatccccgccaccctgctcgtctggcacacctggcagaagcagacgcagcgcagcggcgtgctgtgggacgtgcccagcccgcccgagacccagaaggccgagctggaggagggggtctaccggatcaagcagcagggcatcttcgggaagacccaggtgggcgtgggggtccagaaggagggcgtgttccacaccatgtggcacgtgacgcgcggcgccgtcctcacctacaacgggaagcggctggagcccaactgggccagcgtgaagaaggacctgatctcctacggcgggggctggcgcctcagcgcgcagtggcagaagggggaggaggtgcaggtcatcgccgtggagcccggcaagaaccccaagaacttccagaccatgcccggcaccttccagacgaccaccggggagatcggcgccatcgccctggacttcaagcccgggacctccggcagccccatcatcaaccgggagggcaaggtggtcgggctgtacggcaacggggtggtgacgaagaacggcgggtacgtcagcggcatcgcgcagaccaacgccgagccggacggccccacccccgagctggaggaggagatgttcaagaagcgcaacctcaccatcatggacctgcaccccgggtccggcaagacgcggaagtacctgccggccatcgtgcgcgaggccatcaagcggcgcctccggaccctgatcctggcccccacccgcgtggtcgcggccgagatggaggaggccctcaaggggctgcccatccggtaccagaccacggccaccaagagcgagcacaccggccgcgagatcgtggacctgatgtgccacgccaccttcacgatgcggctcctgtcccccgtgcgcgtcccgaactacaacctgatcatcatggacgaggcgcacttcaccgaccccgccagcatcgccgcccgggggtacatctccacccgcgtgggcatgggcgaggccgcggccatcttcatgaccgccacgccgcccgggaccgccgacgcgttcccgcagagcaacgcccccatccaggacgaggagcgcgacatccccgagcggtcctggaacagcggcaacgagtggatcaccgacttcgccgggaagaccgtgtggttcgtcccctccatcaaggccggcaacgacatcgccaactgcctccgcaagaacgggaagaaggtgatccagctgagccggaagacgttcgacaccgagtaccagaagaccaagctgaacgactgggacttcgtggtcaccaccgacatctccgagatgggcgcgaacttcaaggccgaccgcgtgatcgacccgcggcgctgcctcaagcccgtgatcctgacggacggccccgagcgggtcatcctggccgggcccatgccggtgaccgccgccagcgcggcccagcgccggggccgcgtggggcggaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccggctgaagggcgagagccgcaagaccttcgtcgagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcgcgcacgtacagcgacccgctggccctcaaggagttcaaggacttcgccgccggccggaagtccatcgccctggacctggtgaccgagatcgggcgcgtccccacccacctcgcgcaccggacccgcaacgccctggacaacctggtgatgctccacacgagcgagcacggcgggaaggcctaccggcacgccgtggaggagctgcccgagaccatggagaccctgctcctgctgggcctcatgatcctgctgaccgggggcgccatgctgttcctgatctccggcaaggggatcggcaagacgagcatcgggctgatctgcgtcatcgcgagctccggcatgctctggatggccgagatcccgctgcagtggatcgccagcgccatcgtgctggagttcttcatgatggtgctcctgatccccgagcccgagaagcagcgcacgccccaggacaaccagctggcctacgtcgtgatcgggatcctcaccctggcggccatcatcgccgccaacgagatgggcctgctcgagaccacgaagcgggacctgggcatgtccaaggagccgggggtggtcagccccacctcctacctggacgtggacctccaccccgccagcgcgtggaccctgtacgccgtggccaccacggtcatcacccccatgctgcgccacaccatcgagaactccaccgccaacgtgagcctcgcggccatcgccaaccaggccgtggtcctgatgggcctggacaaggggtggccgatctccaagatggacctcggcgtgcccctgctggccctcgggtgctacagccaggtgaaccccctgacgctgaccgcggccgtcctcctgctgatcacccactacgccatcatcggccccggcctccaggccaaggccacccgggaggcgcagaagcgcacggccgccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcggaccagctgggccctctgcgaggcgctgacgctggccaccggccccatcaccaccctctgggagggctcccccgggaagttctggaacaccacgatcgccgtcagcatggccaacatcttccgcggctcctacctggcgggggccggcctggccttcagcatcatgaagtccgtggggaccggcaagcggggcaccgggagccagggcgagaccctcggggagaagtggaagaagaagctgaaccagctgtcccgcaaggagttcgacctctacaagaagtccggcatcacggaggtggaccggaccgaggccaaggaggggctgaagcgcggcgagatcacccaccacgccgtcagccggggctccgcgaagctgcagtggttcgtggagcgcaacatggtgatcccggaggggcgggtcatcgacctcggctgcgggcgcggcgggtggagctactactgcgccggcctgaagaaggtgaccgaggtgcggggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccgcacgatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgtcccgcaacagcacccacgagatgtactggatctccaacggcaccgggaacatcgtcgccagcgtgaacatggtgtcccggctcctgctgaaccgcttcaccatgacgcaccggcgcccgaccatcgagaaggacgtcgacctcggcgccggcacccggcacgtgaacgcggagcccgagacccccaacatggacgtgatcggggagcgcatcaagcggatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcatccagatggccatgacggacaccacccccttcgggcagcagcgcgtgttcaaggagaaggtggacacccggacgccgcgctccatgcccggcacccggcgcgtcatggagatcaccgcggagtggctctggcggaccctgggccgcaacaagaagccccggctgtgcacgcgcgaggagttcaccaagaaggtgcgcaccaacgccgccatgggggccgtgttcaccgaggagaaccagtgggacagcgcgaaggccgccgtcgaggacgaggacttctggaagctcgtggaccgggagcgcgagctgcacaagctgggcaagtgcgggagctgcgtgtacaacatgatgggcaagcgggagaagaagctcggggagttcggcaaggccaagggctcccgcgccatctggtacatgtggctgggggcgcggtacctggagttcgaggccctcggcttcctgaacgaggaccactggttcagccgcgagaactcctacagcggggtcgagggcgaggggctgcacaagctcggctacatcctgcgggacatctccaagatccccggcggggccatgtacgccgacgacacggccggctgggacacccgcatcaccgaggacgacctgcacaacgaggagaagatcacccagcagatggacccggagcaccggcagctcgcgaacgccatcttcaagctgacctaccagaacaaggtggtgaaggtccagcgccccacgcccaccgggaccgtgatggacatcatcagccggaaggaccagcgcggctccggccaggtggggacctacggcctgaacacgttcaccaacatggaggcccagctcatccggcagatggagggggagggcgtcctgagcaaggccgacctggagaacccccacctcccggagaagaagatcacccagtggctggagaccaagggggtggagcgcctgaagcggatggccatctccggcgacgactgcgtggtcaagcccatcgacgaccgcttcgcgaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccggatcagccagggcgccgggtggtccctccgcgagacggcgtgcctgggcaaggcctacgcccagatgtggagcctgatgtacttccaccgccgggacctccgcctggcctccaacgcgatctgcagcgccgtgcccgtccactgggtgccgacctcccggaccacctggagcatccacgcccaccaccagtggatgacgaccgaggacatgctgaccgtgtggaaccgcgtctggatcgaggacaacccctggatggaggacaagacccccgtgacgacctgggagaacgtgccctacctcggcaagcgggaggaccagtggtgcgggtccctgatcggcctgaccagccgcgccacctgggcccagaacatcccgacggcgatccagcaggtccggagcctcatcgggaacgaggagttcctggactacatgccctccatgaagcgcttccggaaggaggaggagagcgagggcgccatctggtga

SEQ ID NO: 10275 - RNA, 9873 nt, synthetic construct
  misc_feature 1..9873: note = derived and/or modified CDS sequence (opt1) from DENV-3__GQ868586__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggactacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagcagtgcgaccaccggctgatgagcgccgccgtgaaggacgagcgcgccgtccacgccgacatgggctactggatcgagagccagaagaacgggtcctggaagctcgagaaggcgagcctgatcgaggtgaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtcgtgatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtgtccgccggcagcggggaggtggacaacttcaccatgggcgtcctgtgcctggccatcctcttcgaggaggtgatgcgggggaagttcggcaagaagcacatgatcgcgggggtgttcttcaccttcgtcctgctgctctccggccagatcacctggcgcgacatggcccacacgctgatcatgatcggcagcaacgcctccgaccggatggggatgggcgtgacctacctggccctcatcgccaccttcaagatccagcccttcctggcgctggggttcttcctccgcaagctgaccagccgggagaacctgctcctgggcgtgggcctggccatggccacgaccctccagctgcccgaggacatcgagcagatggccaacgggatcgcgctgggcctcatggccctgaagctgatcacccagttcgagacctaccagctctggacggccctgatcagcctgacctgctccaacaccatcttcaccctcacggtcgcctggcgcaccgccaccctgatcctggcgggggtgagcctcctgccggtctgccagtccagctccatgcggaagaccgactggctgcccatgacggtggccgccatgggcgtgccgcccctcccgctgttcatcttcagcctgaaggacaccctcaagcgccgctcctggcccctgaacgagggggtcatggccgtgggcctggtgagcatcctcgcctccagcctgctgcggaacgacgtccccatggcgggccccctcgtggccgggggcctgctgatcgcctgctacgtgatcaccgggacctccgccgacctcacggtcgagaaggccgcggacgtgacctgggaggaggaggccgagcagaccggcgtgagccacaacctgatgatcaccgtcgacgacgacgggaccatgcgcatcaaggacgacgagacggagaacatcctgaccgtgctcctgaagaccgccctgctcatcgtgtccggcatcttcccgtacagcatccccgccaccctgctggtctggcacacgtggcagaagcagacccagcggtccggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctgacctacaacgggaagcgcctcgagcccaactgggcctccgtgaagaaggacctgatcagctacggcgggggctggcggctgtccgcccagtggcagaagggggaggaggtgcaggtcatcgccgtggagcccggcaagaaccccaagaacttccagaccatgcccggcacgttccagaccaccaccggggagatcggcgcgatcgccctcgacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctgacgatcatggacctccaccccgggagcggcaagacccgcaagtacctgccggccatcgtgcgggaggcgatcaagcgccggctgcgcaccctcatcctggcccccacccgggtggtcgccgccgagatggaggaggccctgaaggggctccccatccgctaccagacgaccgcgaccaagtccgagcacaccggccgggagatcgtggacctgatgtgccacgccacgttcaccatgcgcctgctcagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctgcggaagaacgggaagaaggtgatccagctctcccgcaagaccttcgacaccgagtaccagaagaccaagctgaacgactgggacttcgtggtcacgaccgacatcagcgagatgggcgccaacttcaaggccgaccgggtgatcgacccgcgccggtgcctgaagcccgtgatcctcaccgacggccccgagcgcgtcatcctggccgggcccatgccggtgaccgcggcctccgccgcccagcggcgcggccgggtggggcgcaacccccagaaggagaacgaccagtacatcttcaccggccagcccctgaacaacgacgaggaccacgcccactggacggaggcgaagatgctcctggacaacatcaacacccccgaggggatcatcccggccctgttcgagcccgagcgggagaagtccgccgccatcgacggcgagtaccgcctcaagggcgagtcccggaagaccttcgtcgagctgatgcgccgcggggacctgcccgtgtggctcgcgcacaaggtcgccagcgagggcatcaagtacaccgaccgcaagtggtgcttcgacgggcagcggaacaaccagatcctggaggagaacatggacgtggagatctggacgaaggagggcgagaagaagaagctgcgcccccggtggctcgacgcccgcacctactccgacccgctggccctgaaggagttcaaggacttcgccgcgggccgcaagagcatcgccctcgacctggtgaccgagatcgggcgggtcccctcccacctggcccaccgcacccggaacgccctcgacaacctggtgatgctgcacacgagcgagcacggcgggaaggcctaccgccacgcggtggaggagctccccgagaccatggagaccctgctgctcctgggcctgatgatcctcctgaccgggggcgccatgctgttcctcatcagcggcaaggggatcggcaagacgtccatcgggctgatctgcgtcatcgccagctccggcatgctgtggatggccgagatcccgctccagtggatcgccagcgcgatcgtgctggagttcttcatgatggtgctgctcatccccgagcccgagaagcagcggacgccccaggacaaccagctggcctacgtcgtgatcgggatcctgaccctcgccgccatcatcgccgcgaacgagatgggcctgctggagaccacgaagcgcgacctcggcatgtccaaggagccgggggtggtcagccccacctcctacctggacgtggacctgcaccccgccagcgcctggaccctctacgccgtggcgaccacggtcatcacccccatgctgcggcacaccatcgagaactccaccgccaacgtgagcctggccgccatcgccaaccaggcggtggtcctcatgggcctggacaaggggtggccgatctccaagatggacctgggcgtgcccctcctggccctggggtgctacagccaggtgaaccccctcacgctgaccgccgccgtcctgctcctgatcacccactacgccatcatcggccccggcctgcaggcgaaggccacccgcgaggcccagaagcggacggccgccgggatcatgaagaacccgaccgtggacggcatcatgaccatcgacctcgaccccgtgatctacgactccaagttcgagaagcagctggggcaggtcatgctgctcgtgctgtgcgcggtgcagctgctcctgatgcgcaccagctgggccctgtgcgaggccctcacgctggccaccggccccatcaccaccctgtgggagggctcccccgggaagttctggaacacgaccatcgcggtcagcatggccaacatcttccggggctcctacctcgccggggccggcctggccttcagcatcatgaagtccgtggggaccggcaagcgcggcaccgggagccagggcgagaccctgggggagaagtggaagaagaagctcaaccagctgagccggaaggagttcgacctgtacaagaagtccggcatcacggaggtggaccgcaccgaggcgaaggaggggctcaagcggggcgaggtcacccaccacgccgtgagccgcggctccgccaagctgcagtggttcgtggagcggaacatggtcatcccggaggggcgcgtgatcgacctgggctgcgggcggggcgggtggagctactactgcgccggcctcaagaaggtgaccgaggtccgcggctacacgaagggcgggcccgggcacgaggagcccgtgcccatgtccacctacggctggaacatcgtgaagctgatgagcgggaaggacgtcttctacctgccgcccgagaagtgcgacaccctcctgtgcgacatcggcgagtccagcccctcccccaccgtggaggagagccggacgatccgcgtgctgaagatggtcgagccgtggctgaagaacaaccagttctgcatcaaggtgctcaacccctacatgcccaccgtgatcgagcacctggagcgcctgcagcggaagcacggcgggatgctcgtccgcaaccccctgtcccggaacagcacccacgagatgtactggatctccaacggcaccgggaacatcgtggccagcgtgaacatggtctcccgcctgctcctgaaccggttcacgatgacccaccgccggccgaccatcgagaaggacgtggacctgggcgcgggcacccgccacgtgaacgccgagcccgagacgcccaacatggacgtcatcggggagcggatcaagcgcatcaaggaggagcacaacagcacctggcactacgacgacgagaacccgtacaagacctgggcctaccacggctcctacgaggtgaaggccaccgggagcgcctccagcatgatcaacggcgtcgtgaagctcctgacgaagccctgggacgtggtccccatggtgacccagatggcgatgaccgacaccacgcccttcgggcagcagcgggtgttcaaggagaaggtcgacacccgcaccccgcggagcatgcccggcacccgccgggtgatgggcatcacggccgagtggctgtggcgcaccctcgggcggaacaagaagccccgcctgtgcacccgggaggagttcaccaagaaggtgcgcacgaacgccgccatgggcgcggtcttcaccgaggagaaccagtgggactccgccaaggccgccgtggaggacgaggacttctggaagctggtggagcgcgagcgggagctccacaagctggggaagtgcggcagctgcgtctacaacatgatggggaagcgcgagaagaagctgggcgagttcggcaaggccaaggggtcccgggcgatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgccatgtacgccgacgacaccgcggggtgggacacccggatcacggaggacgacctgcacaacgaggagaagatcacccagcagatggacccggagcacaagcagctggccaacgccatcttcaagctcacctaccagaacaaggtggtcaaggtgcagcgccccacccccaccggcacggtgatggacatcatcagccggaaggaccagcgcggctccgggcaggtcggcacctacgggctgaacaccttcaccaacatggaggcccagctgatccggcagatggagggcgagggggtgctcagcaaggccgacctggagaacccccacctccccgagaagaagatcacgcagtggctggagaccaagggcgtggagcgcctgaagcggatggcgatctccggcgacgactgcgtcgtgaagcccatcgacgaccgcttcgccaacgccctgctcgccctgaacgacatggggaaggtgcggaaggacatcccccagtggcagcccagcaagggctggcacgactggcagcaggtcccgttctgctcccaccacttccacgagctgatcatgaaggacgggcgcaagctcgtggtgccctgccggccccaggacgagctgatcggccgcgcccggatcagccagggggcgggctggtccctgcgcgagaccgcctgcctcgccaaggcctacgcgcagatgtggagcctgatgtacttccaccggcgcgacctgcgcctcgcctccaacgccatctgcagcgccgtccccgtgcactgggtgccgacctcccggacgacctggagcatccacgcccaccaccagtggatgaccaccgaggacatgctgacggtctggaaccgcgtgtggatcgaggacaacccctggatggaggacaagacccccgtgaccacctgggagaacgtcccctacctgggcaagcgggaggaccagtggtgcgggagcctcatcggcctgacgtcccgcgcgacctgggcccagaacatcccgaccgccatccagcaggtccggagcctgatcgggaacgaggagttcctcgactacatgccctccatgaagcgcttccggaaggaggaggagagcgagggcgccatctggtga

SEQ ID NO: 10276 - RNA, 9873 nt, synthetic construct
  misc_feature 1..9873: note = derived and/or modified CDS sequence (opt1) from DENV-3__FJ850110__SS-prME
  source 1..9873: mol_type = other RNA
accagcctctgcctcatgatgatcctgcccgcggcgctggcgttccacctcaccagccgggacggcgagccgcggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggcccggatcgtcaccgccgagacgcagaacagctccttcatcatcgacggccccaacacccccgagtgccccaacaccagccgcgcctggaacgtgtgggaggtggaggactacgggttcggcgtcttcaccaccaacatctggctcaagctgcgggaggtgtacacgcagctgtgcgaccaccgcctcatgtccgcggccgtgaaggacgagcgggccgtccacgccgacatgggctactggatcgagagccagaagaacgggagctggaagctggagaaggcctccctgatcgaggtgaagacctgcacctggcccaagtcccacaccctctggtccaacggcgtgctggagagcgacatgatcatccccaagtccctggcggggcccatcagccagcacaactaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtgtccgccggcagcggggaggtggacaacttcaccatgggcgtcctgtgcctcgccatcctgttcgaggaggtgatgcgcgggaagttcggcaagaagcacatgatcgccggggtgttcttcaccttcgtcctgctcctgtccggccagatcacgtggcgggacatggcgcacaccctgatcatgatcggcagcaacgccaccgaccgcatggggatgggcgtgacctacctcgccctgatcgccacgttcaagatccagcccttcctggccctcgggttcttcctgcggaagctgacctcccgcgagaacctcctgctgggcgtgggcctcgcgatggccaccaccctgcagctgcccgaggacatcgagcagatggccaacgggatcgccctcggcctgatggcgctgaagctcatcacgcagttcgagacctaccagctgtggaccgccctgatcagcctgacctgctccaacacgatcttcaccctgaccgtcgcctggcggaccgccacgctgatcctcgccggggtgagcctgctgccggtctgccagagctccagcatgcgcaagaccgactggctccccatgaccgtggcggccatgggcgtgccgcccctcccgctgttcatcttctccctcaaggacaccctgaagcgccggagctggcccctgaacgagggggtcatggccgtgggcctcgtgtccatcctggccagctccctgctccgcaacgacgtccccatggccggccccctggtggccggcgggctgctcatcgcctgctacgtgatcacggggaccagcgccgacctgaccgtcgagaaggccgccgacgtgacctgggaggaggaggcggagcagaccggggtgtcccacaacctgatgatcacggtcgacgacgacgggaccatgcggatcaaggacgacgagaccgagaacatcctcaccgtgctgctgaagacggccctcctgatcgtgagcggcatcttcccgtactccatccccgccaccctgctcgtctggcacacctggcagaagcagacccagcgcagcggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggcgagcgtgaagaaggacctgatctcctacggcgggggctggcgcctcagcgcccagtggcagaagggggaggaggtgcaggtcatcgccgtggagcccggcaagaaccccaagaacttccagaccatgcccggcaccttccagaccacgaccggggagatcggcgccatcgcgctggacttcaagcccgggacctccggcagccccatcatcaaccgggagggcaaggtggtcgggctgtacggcaacggggtggtgaccaagaacggcgggtacgtctccggcatcgcccagacgaacgccgagccggacggccccacccccgagctggaggaggagatgttcaagaagcgcaacctcaccatcatggacctgcaccccgggagcggcaagacccggaagtacctgccggccatcgtgcgcgaggccatcaagcggcgcctccggacgctgatcctggcgcccacccgcgtggtcgccgccgagatggaggaggccctcaaggggctgcccatccggtaccagaccaccgccaccaagagcgagcacaccggccgcgagatcgtggacctgatgtgccacgcgaccttcaccatgcggctcctgtcccccgtgcgcgtcccgaactacaacctgatcatcatggacgaggcccacttcacggaccccgccagcatcgccgcccgggggtacatctccacccgcgtgggcatgggcgaggcggccgccatcttcatgaccgccacgccgcccgggacggcggacgccttcccgcagagcaacgcccccatccaggacgaggagcgcgacatccccgagcggtcctggaacagcggcaacgagtggatcaccgacttcgccgggaagaccgtgtggttcgtcccctccatcaaggccggcaacgacatcgcgaactgcctccgcaagaacgggaagaaggtgatccagctgagccggaagaccttcgacacggagtaccagaagaccaagctgaacgactgggacttcgtggtcaccaccgacatctccgagatgggcgccaacttcaaggccgaccgcgtgatcgacccgcggcgctgcctcaagcccgtgatcctgaccgacggccccgagcgggtcatcctggccgggcccatgccggtgacggccgcgagcgccgcccagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgccgccatcgacggcgagtaccggctgaagggcgagagccgcaagacgttcgtcgagctgatgcggcgcggggacctccccgtgtggctggcccacaaggtcgcgtccgagggcatcaagtacaccgaccggaagtggtgcttcgacgggcagcgcaacaaccagatcctggaggagaacatggacgtggagatctggaccaaggagggcgagaagaagaagctccggccccgctggctggacgcccgcacctacagcgacccgctggccctcaaggagttcaaggacttcgccgccggccggaagtccatcgcgctggacctggtgacggagatcgggcgcgtccccacccacctcgcccaccggacccgcaacgccctggacaacctggtgatgctccacaccagcgagcacggcgggaaggcctaccggcacgccgtggaggagctgcccgagacgatggagaccctgctcctgctgggcctcatgatcctgctgaccgggggcgcgatgctgttcctgatctccggcaaggggatcggcaagaccagcatcgggctgatctgcgtcatcgcctccagcggcatgctctggatggccgagatcccgctgcagtggatcgccagcgccatcgtgctggagttcttcatgatggtgctcctgatccccgagcccgagaagcagcgcacgccccaggacaaccagctggcgtacgtcgtgatcgggatcctcaccctggccgccatcatcgccgccaacgagatgggcctgctcgagaccaccaagcgggacctgggcatgtccaaggagccgggggtggtcagccccacgtcctacctggacgtggacctccaccccgcgagcgcctggaccctgtacgccgtggccaccaccgtcatcacgcccatgctgcgccacaccatcgagaactccaccgcgaacgtgagcctcgccgccatcgccaaccaggccgtggtcctgatgggcctggacaaggggtggccgatctccaagatggacctcggcgtgcccctgctggcgctcgggtgctacagccaggtgaaccccctgaccctgacggccgccgtcctcctgctgatcacccactacgccatcatcggccccggcctccaggccaaggcgacccgggaggcccagaagcgcaccgccgccgggatcatgaagaacccgacggtggacggcatcatgaccatcgacctggaccccgtgatctacgactccaagttcgagaagcagctggggcaggtcatgctcctggtgctgtgcgccgtgcagctcctgctgatgcggaccagctgggcgctctgcgaggccctgaccctggccacgggccccatcaccaccctctgggagggctcccccgggaagttctggaacaccaccatcgccgtcagcatggcgaacatcttccgcggctcctacctggccggggccggcctggccttcagcatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtggaccggacggaggccaaggaggggctgaagcgcggcgagatcacccaccacgcggtctcccggggcagcgccaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcggccccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgtcccgcaacagcacgcacgagatgtactggatctccaacggcaccgggaacatcgtcgccagcgtgaacatggtgtcccggctcctgctgaaccgcttcaccatgacccaccggcgcccgacgatcgagaaggacgtcgacctcggcgcgggcacccggcacgtgaacgccgagcccgagacccccaacatggacgtgatcggggagcgcatcaagcggatcaaggaggagcacaacagcacctggcactacgacgacgagaacccgtacaagacgtgggcctaccacggctcctacgaggtcaaggccaccgggagcgcctccagcatgatcaacggcgtggtcaagctgctgaccaagccctgggacgtggtgcccatggtcacccagatggcgatgacggacaccacccccttcgggcagcagcgcgtgttcaaggagaaggtggacacccggacgccgcgctccatgcccggcacccggcgcgtcatggagatcaccgccgagtggctctggcggaccctgggccgcaacaagaagccccggctgtgcacgcgcgaggagttcaccaagaaggtgcgcaccaacgccgccatgggggcggtgttcaccgaggagaaccagtgggacagcgccaaggccgccgtcgaggacgaggacttctggaagctcgtggaccgggagcgcgagctgcacaagctgggcaagtgcgggtcctgcgtgtacaacatgatgggcaagcgggagaagaagctcggggagttcggcaaggccaagggcagccgcgcgatctggtacatgtggctgggggcccggtacctggagttcgaggccctcggcttcctgaacgaggaccactggttcagccgcgagaactcctacagcggggtcgagggcgaggggctgcacaagctcggctacatcctgcgggacatctccaagatccccggcggggccatgtacgccgacgacacggcgggctgggacacccgcatcaccgaggacgacctgcacaacgaggagaagatcacccagcagatggacccggagcaccggcagctcgccaacgccatcttcaagctgacctaccagaacaaggtggtgaaggtccagcgccccacgcccaccgggaccgtgatggacatcatcagccggaaggaccagcgcggctccggccaggtggggacctacggcctgaacacgttcaccaacatggaggcccagctcatccggcagatggagggggagggcgtcctgagcaaggccgacctggagaacccccacctcccggagaagaagatcacccagtggctggagaccaagggggtggagcgcctgaagcggatggcgatctccggcgacgactgcgtggtcaagcccatcgacgaccgcttcgccaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccggatcagccagggcgcggggtggtccctccgcgagacggcctgcctgggcaaggcctacgcccagatgtggagcctgatgtacttccaccgccgggacctccgcctggcgtccaacgccatctgcagcgccgtgcccgtccactgggtgccgacctcccggaccacctggagcatccacgcccaccaccagtggatgacgaccgaggacatgctgaccgtgtggaaccgcgtctggatcgaggacaacccctggatggaggacaagacccccgtgacgacctgggagaacgtgccctacctcggcaagcgggaggaccagtggtgcgggtccctgatcggcctgaccagccgcgccacctgggcgcagaacatcccgacggccatccagcaggtccggtccctcatcgggaacgaggagttcctggactacatgcccagcatgaagcgcttccggaaggaggaggagagcgagggcgccatctggtga

SEQ ID NO: 10277 - RNA, 9873 nt, synthetic construct
  misc_feature 1..9873: note = derived and/or modified CDS sequence (opt1) from DENV-3__FJ850111__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagacggcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaactccctgaagatcaactggtacaagaagggcagctccatcgggaagatgttcgaggccaccgcgcggggcgcccgccggatggccatcctgggcgacaccgcctgggacttcgggagcgtgggcggggtcctcaactccctgggcaagatggtgcaccagatcttcgggagcgcctacacggcgctgttctccggcgtgagctgggtcatgaagatcggcatcggggtgctcctgacctggatcggcctgaactccaagaacaccagcatgtccttcagctgcatcgccatcgggatcatcaccctctacctgggcgccgtggtccaggccgacacggggtgcgtgatcaactggaagggcaaggagctgaagtgcggctccgggatcttcgtgaccaacgaggtccacacctggaccgagcagtacaagttccaggccgacagccccaagcgcctcgcgacggccatcgccggcgcctgggagaacggggtgtgcggcatccgctccaccacccggatggagaacctgctgtggaagcagatcgccaacgagctcaactacatcctgtgggagaacaacatcaagctgaccgtggtcgtgggggacatcatcggcgtgctcgagcagggcaagcgcacgctgacgccccagccgatggagctgaagtacagctggaagacctgggggaaggcgcggatcgtcaccgccgagacgcagaactccagcttcatcatcgacggccccaacacccccgagtgccccaacacctcccgcgcctggaacgtgtgggaggtggaggactacgggttcggcgtcttcaccaccaacatctggctcaagctgcgggaggtgtacacgcagctgtgcgaccaccgcctcatgagcgccgcggtgaaggacgagcgggccgtccacgccgacatgggctactggatcgagagccagaagaacgggtcctggaagctggagaaggccagcctgatcgaggtgaagacctgcacctggccgaagtcccacaccctctggagcaacggcgtgctggagtccgacatgatcatccccaagagcctggccgggcccatctcccagcacaactaccgcccgggctaccacacgcagaccgcggggccctggcacctcggcaagctggagctggacttcaactactgcgagggcaccaccgtcgtgatcacggagaactgcgggacccggggccccagcctccgcaccaccacggtgtccgggaagctgatccacgagtggtgctgccggagctgcaccctgcccccgctccgctacatgggcgaggacgggtgctggtacggcatggagatccggcccatctccgagaaggaggagaacatggtcaagagcctggtgtccgccggcagcggggaggtggacaacttcaccatgggcgtcctgtgcctcgccatcctgttcgaggaggtgatgcgcgggaagttcggcaagaagcacatgatcgccggggtgttcttcaccttcgtcctgctcctgtccggccagatcacgtggcgggacatggcccacaccctgatcatgatcggcagcaacgcgaccgaccgcatggggatgggcgtgacctacctcgccctgatcgccacgttcaagatccagcccttcctggccctcgggttcttcctgcggaagctgacctcccgcgagaacctcctgctgggcgtgggcctcgccatggcgaccaccctgcagctgcccgaggacatcgagcagatggccaacgggatcgccctcggcctgatggccctgaagctcatcacgcagttcgagacctaccagctgtggaccgcgctgatcagcctgacctgcagcaacacgatcttcaccctgaccgtcgcctggcggaccgccacgctgatcctcgccggggtgtccctgctgccggtctgccagagctccagcatgcgcaagaccgactggctccccatgaccgtggccgcgatgggcgtgccgcccctcccgctgttcatcttctccctcaaggacaccctgaagcgccggagctggcccctgaacgagggggtcatggccgtgggcctcgtgtccatcctggccagctccctgctccgcaacgacgtccccatggccggccccctggtggccgggggcctgctcatcgcgtgctacgtgatcacggggaccagcgccgacctgaccgtcgagaaggccgccgacgtgacctgggaggaggaggccgagcagaccggcgtgtcccacaacctgatgatcacggtcgacgacgacgggaccatgcggatcaaggacgacgagaccgagaacatcctcaccgtgctgctgaagacggcgctcctgatcgtgagcggcatcttcccgtactccatccccgccaccctgctcgtctggcacacctggcagaagcagacccagcgcagcggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgtacaacgggaagcggctggagcccaactgggccagcgtgaagaaggacctgatctcctacggcgggggctggcgcctcagcgcgcagtggcagaagggggaggaggtgcaggtcatcgccgtggagcccggcaagaaccccaagaacttccagaccatgcccggcaccttccagaccacgaccggggagatcggcgccatcgccctggacttcaagcccgggacctccggcagccccatcatcaaccgggagggcaaggtggtcgggctgtacggcaacggggtggtgaccaagaacggcgggtacgtcagcggcatcgcgcagacgaacgccgagccggacggccccacccccgagctggaggaggagatgttcaagaagcgcaacctcaccatcatggacctgcaccccgggtccggcaagacccggaagtacctgccggccatcgtgcgcgaggccatcaagcggcgcctccggacgctgatcctggcccccacccgcgtggtcgcggccgagatggaggaggccctcaaggggctgcccatccggtaccagaccaccgccaccaagtccgagcacaccggccgcgagatcgtggacctgatgtgccacgccaccttcaccatgcggctcctgtcccccgtgcgcgtcccgaactacaacctgatcatcatggacgaggcgcacttcacggaccccgccagcatcgccgcccgggggtacatctccacccgcgtgggcatgggcgaggccgcggccatcttcatgaccgccacgccgcccgggacggccgacgcgttcccgcagagcaacgcccccatccaggacgaggagcgcgacatccccgagcggtcctggaacagcggcaacgagtggatcaccgacttcgccgggaagaccgtgtggttcgtcccctccatcaaggccggcaacgacatcgccaactgcctccgcaagaacgggaagaaggtgatccagctgagccggaagaccttcgacacggagtaccagaagaccaagctgaacgactgggacttcgtggtcaccaccgacatctccgagatgggcgcgaacttcaaggccgaccgcgtgatcgacccgcggcgctgcctcaagcccgtgatcctgaccgacggccccgagcgggtcatcctggccgggcccatgccggtgacggccgccagcgcggcccagcgccggggccgcgtggggcggaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgaagggcgagagccgcaagacgttcgtcgagctgatgcggcgcggggacctccccgtgtggctggcccacaaggtcgcctccgagggcatcaagtacaccgaccggaagtggtgcttcgacgggcagcgcaacaaccagatcctggaggagaacatggacgtggagatctggaccaaggagggcgagaagaagaagctccggccccgctggctggacgcgcgcacctacagcgacccgctggccctcaaggagttcaaggacttcgccgccggccggaagtccatcgccctggacctggtgacggagatcgggcgcgtccccacccacctcgcgcaccggacccgcaacgccctggacaacctggtgatgctccacaccagcgagcacggcgggaaggcctaccggcacgccgtggaggagctgcccgagacgatggagaccctgctcctgctgggcctcatgatcctgctgaccgggggcgccatgctgttcctgatctccggcaaggggatcggcaagaccagcatcgggctgatctgcgtcatcgcgagctccggcatgctctggatggccgagatcccgctgcagtggatcgccagcgccatcgtgctggagttcttcatgatggtgctcctgatccccgagcccgagaagcagcgcacgccccaggacaaccagctggcctacgtcgtgatcgggatcctcaccctggcggccatcatcgccgccaacgagatgggcctgctcgagaccaccaagcgggacctgggcatgtccaaggagccgggggtggtcagccccacgtcctacctggacgtggacctccaccccgccagcgcgtggaccctgtacgccgtggccaccaccgtcatcacgcccatgctgcgccacaccatcgagaactccaccgccaacgtgagcctcgcggccatcgccaaccaggccgtggtcctgatgggcctggacaaggggtggccgatctccaagatggacctcggcgtgcccctgctggccctcgggtgctacagccaggtgaaccccctgaccctgacggcggccgtcctcctgctgatcacccactacgccatcatcggccccggcctccaggccaaggccacccgggaggcgcagaagcgcaccgccgccgggatcatgaagaacccgacggtggacggcatcatgaccatcgacctggaccccgtgatctacgactccaagttcgagaagcagctggggcaggtcatgctcctggtgctgtgcgccgtgcagctcctgctgatgcggaccagctgggccctctgcgaggcgctgaccctggccacgggccccatcaccaccctctgggagggctcccccgggaagttctggaacaccaccatcgccgtcagcatggccaacatcttccgcggctcctacctggcgggggccggcctggccttcagcatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtggaccggacggaggccaaggaggggctgaagcgcggcgagatcacccaccacgccgtcagccggggctccgcgaagctgcagtggttcgtggagcgcaacatggtgatcccggaggggcgggtcatcgacctcggctgcgggcgcggcgggtggagctactactgcgccggcctgaagaaggtgaccgaggtgcggggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccgcaccatccgcgtgctgaagatggtggagccgtggctcaagaacaaccagttctgcatcaaggtcctgaacccctacatgcccgccgtgatcgagcacctggagcggctccagcgcaagcacggcgggatgctggtgcggaaccccctgtcccgcaacagcacgcacgagatgtactggatctccaacggcaccgggaacatcgtcgccagcgtgaacatggtgtcccggctcctgctgaaccgcttcaccatgacccaccggcgcccgacgatcgagaaggacgtcgacctcggcgccggcacccggcacgtgaacgcggagcccgagacccccaacatggacgtgatcggggagcgcatcaagcggatcaaggaggagcacaacagcacctggcactacgacgacgagaacccgtacaagacgtgggcctaccacggctcctacgaggtcaaggccaccgggagcgcctccagcatgatcaacggcgtggtcaagctgctgaccaagccctgggacgtggtgcccatggtcatccagatggccatgaccgacacgacccccttcgggcagcagcgcgtgttcaaggagaaggtggacacccggaccccgcgctccatgcccggcacgcggcgcgtcatggagatcaccgcggagtggctctggcggaccctgggccgcaacaagaagccccggctgtgcacccgcgaggagttcacgaagaaggtgcgcaccaacgccgccatgggggccgtgttcaccgaggagaaccagtgggacagcgcgaaggccgccgtcgaggacgaggacttctggaagctcgtggaccgggagcgcgagctgcacaagctgggcaagtgcgggagctgcgtgtacaacatgatgggcaagcgggagaagaagctcggggagttcggcaaggccaagggctcccgcgccatctggtacatgtggctgggggcgcggtacctggagttcgaggccctcggcttcctgaacgaggaccactggttcagccgcgagaactcctacagcggggtcgagggcgaggggctgcacaagctcggctacatcctgcgggacatctccaagatccccggcggggccatgtacgccgacgacaccgccggctgggacacgcgcatcaccgaggacgacctgcacaacgaggagaagatcacccagcagatggacccggagcaccggcagctcgcgaacgccatcttcaagctgacctaccagaacaaggtggtgaaggtccagcgccccacccccacggggaccgtgatggacatcatcagccggaaggaccagcgcggctccggccaggtggggacctacggcctgaacaccttcacgaacatggaggcccagctcatccggcagatggagggggagggcgtcctgagcaaggccgacctggagaacccccacctcccggagaagaagatcacccagtggctggagaccaagggggtggagcgcctgaagcggatggccatctccggcgacgactgcgtggtcaagcccatcgacgaccgcttcgcgaacgccctcctggccctgaacgacatgggcaaggtgcggaaggacatcccccagtggcagcccagcaaggggtggcacgactggcagcaggtcccgttctgctcccaccacttccacgagctcatcatgaaggacggccgcaagctggtcgtgccctgccggccccaggacgagctgatcgggcgcgcccggatcagccagggcgccgggtggtccctccgcgagaccgcgtgcctgggcaaggcctacgcccagatgtggagcctgatgtacttccaccgccgggacctccgcctggcctccaacgcgatctgcagcgccgtgcccgtccactgggtgccgacgtcccggaccacctggagcatccacgcccaccaccagtggatgaccacggaggacatgctgaccgtgtggaaccgcgtctggatcgaggacaacccctggatggaggacaagacccccgtgaccacgtgggagaacgtgccctacctcggcaagcgggaggaccagtggtgcgggtccctgatcggcctgaccagccgcgccacctgggcccagaacatcccgaccgcgatccagcaggtccggagcctcatcgggaacgaggagttcctggactacatgccctccatgaagcgcttccggaaggaggaggagagcgagggcgccatctggtga

SEQ ID NO: 10278 - RNA, 9873 nt, synthetic construct
  misc_feature 1..9873: note = derived and/or modified CDS sequence (opt1) from DENV-3__KF955486__SS-prME
  source 1..9873: mol_type = other RNA
accagcctctgcctcatgatgatcctgcccgccgccctggcgttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcacgctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagaaggacatccccgagcgcagctggaactccggcaacgagtggatcaccgacttcgccgggaagacggtgtggttcgtccccagcatcaaggcgggcaacgacatcgccaactgcctccgcaagaacgggaagaaggtgatccagctgtcccggaagaccttcgacaccgagtaccagaagaccaagctgaacgactgggacttcgtggtcacgaccgacatcagcgagatgggcgccaacttcaaggccgaccgcgtgatcgacccgcggcgctgcctcaagcccgtgatcctgaccgacggccccgagcgggtcatcctggccgggcccatgccggtgaccgcggcctccgccgcccagcgccggggccgcgtggggcggaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgcgagaagtccgccgccatcgacggcgagtaccggctgaagggcgagtcccgcaagaccttcgtcgagctgatgcggcgcggggacctccccgtgtggctggcgcacaaggtcgccagcgagggcatcaagtacaccgaccggaagtggtgcttcgacgggcagcgcaacaaccagatcctggaggagaacatggacgtggagatctggacgaaggagggcgagaagaagaagctccggccccgctggctggacgcccggacctactccgacccgctggccctcaaggagttcaaggacttcgccgcgggccgcaagagcatcgccctggacctggtgaccgagatcgggcgcgtccccacccacctcgcccaccggacgcgcaacgccctggacaacctggtgatgctccacacctccgagcacggcgggaaggcctaccggcacgcggtggaggagctgcccgagaccatggagaccctgctcctgctgggcctcatgatcctgctgaccggcggggccatgctgttcctgatcagcgggaaggggatcggcaagaccagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcgcacgccccaggacaaccagctggcctacgtcgtgatcgggatcctcaccctggccgccatcatcgccgcgaacgagatgggcctgctcgagacgaccaagcgggacctgggcatgagcaaggagccgggggtggtctcccccaccagctacctggacgtggacctccaccccgcctccgcctggaccctgtacgccgtggcgacgaccgtcatcacccccatgctgcgccacaccatcgagaacagcacggccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgaccgccgccgtcctcctgctgatcacccactacgccatcatcggccccggcctccaggcgaaggccacgcgggaggcccagaagcgcaccgccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcggacgtcctgggccctctgcgaggccctgaccctggccaccggccccatcaccacgctctgggagggcagccccgggaagttctggaacaccaccatcgcggtctccatggccaacatcttccgcggcagctacctggccggggccggcctggccttctccatcatgaagtccgtggggaccggcaagcggggcaccgggtcccagggcgagacgctcggggagaagtggaagaagaagctgaaccagctgagccgcaaggagttcgacctctacaagaagtccggcatcaccgaggtggaccggaccgaggcgaaggaggggctgaagcgcggcgagatcacccaccacgccgtctcccggggcagcgccaagctgcagtggttcgtggagcgcaacatggtgatcccggaggggcgggtcatcgacctcggctgcgggcgcggcgggtggtcctactactgcgccggcctgaagaaggtgacggaggtgcggggctacaccaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccacggtcgaggagtcccgcaccatccgggtgctgaagatggtggagccgtggctcaagaacaaccagttctgcatcaaggtcctgaacccctacatgcccaccgtgatcgagcacctggagcgcctccagcgcaagcacggcgggatgctggtgcggaaccccctgagccgcaactccacccacgagatgtactggatcagcaacggcacggggaacatcgtcgcctccgtgaacatggtgagccggctcctgctgaaccgcttcaccatgacccaccggcgcccgaccatcgagaaggacgtcgacctcggcgcgggcacgcggcacgtgaacgccgagcccgagacccccaacatggacgtgatcggggagcgcatcaagcggatcaaggaggagcacaactccacctggcactacgacgacgagaacccgtacaagacctgggcctaccacggcagctacgaggtcaaggccacggggtccgccagctccatgatcaacggcgtggtcaagctgctgaccaagccctgggacgtggtgcccatggtcacccagatggcgatgaccgacacgacccccttcgggcagcagcgcgtgttcaaggagaaggtggacacccggaccccgcgcagcatgcccggcacgcggcgcgtcatgggcatcaccgccgagtggctctggcggaccctggggcgcaacaagaagccccggctgtgcacccgcgaggagttcacgaagaaggtgcggaccaacgccgccatgggcgcggtgttcaccgaggagaaccagtgggacagcgccaaggccgccgtcgaggacgaggacttctggaagctcgtggaccgcgagcgcgagctgcacaagctggggaagtgcggctcctgcgtgtacaacatgatggggaagcgggagaagaagctcggcgagttcggcaaggccaaggggagccgcgcgatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgccatgtacgccgacgacaccgcggggtgggacacgcgcatcaccgaggacgacctgcacaacgaggagaagatcacccagcagatggacccggagcaccggcagctcgccaacgccatcttcaagctgacctaccagaacaaggtggtgaaggtccagcgccccacccccacgggcaccgtgatggacatcatctcccggaaggaccagcgcggcagcggccaggtgggcacctacgggctgaacaccttcacgaacatggaggcccagctcatccggcagatggagggcgagggggtcctgtccaaggccgacctggagaacccccacctcccggagaagaagatcacccagtggctggagaccaagggcgtggagcgcctgaagcggatggcgatcagcggcgacgactgcgtggtcaagcccatcgacgaccgcttcgccaacgccctcctggccctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggcgggctggagcctccgcgagaccgcctgcctgggcaaggcctacgcccagatgtggtccctgatgtacttccaccggcgcgacctccgcctggcgagcaacgccatctgctccgccgtgcccgtccactgggtgccgacgagccggaccacctggtccatccacgcccaccaccagtggatgaccacggaggacatgctgaccgtgtggaaccgcgtctggatcgaggacaacccctggatggaggacaagacccccgtgaccacgtgggagaacgtgccctacctcgggaagcgggaggaccagtggtgcggcagcctgatcgggctgaccagccgcgccacctgggcgcagaacatcccgaccgccatccagcaggtccggtccctcatcggcaacgaggagttcctggactacatgcccagcatgaagcgcttccggaaggaggaggagtccgagggggccatctggtga

SEQ ID NO: 10279 - RNA, 9873 nt, synthetic construct
  misc_feature 1..9873: note = derived and/or modified CDS sequence (opt1) from DENV-3__FJ898468__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagacggcctccgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacgtgatcggcgtcctcgagcagggcaagcgcaccctgacgccccagccgatggagctgaagtactcctggaagacctgggggaaggccaagatcgtgaccgccgagacccagaacagctccttcatcatcgacggccccaacacgcccgagtgccccagcgcctcccgggcgtggaacgtgtgggaggtcgaggactacgggttcggcgtgttcaccaccaacatctggctcaagctgcgcgaggtgtacacccagctgtgcgaccaccggctcatgagcgccgccgtcaaggacgagcgcgccgtgcacgccgacatgggctactggatcgagagccagaagaacgggtcctggaagctggagaaggcgagcctgatcgaggtgaagacctgcacgtggccgaagtcccacaccctctggagcaacggcgtcctggagtccgacatgatcatccccaagagcctggccgggcccatctcccagcacaactaccggccgggctaccacacccagaccgccgggccctggcacctcggcaagctggagctggacttcaactactgcgagggcacgaccgtggtgatcaccgagaactgcgggacccgcggccccagcctccggacgaccaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtcgacaacttcacgatgggcgtgctgtgcctcgccatcctgttcgaggaggtgatgcgggggaagttcggcaagaagcacatgatcgcgggggtcttcttcaccttcgtgctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtcggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtggcctggcgcacggccaccctgatcctcgcgggggtcagcctgctgccggtgtgccagtccagctccatgcggaagaccgactggctccccatgaccgtggccgccatgggcgtgccgcccctcccgctgttcatcttcagcctcaaggacacgctgaagcgccgctcctggcccctgaacgagggggtgatggccgtgggcctcgtcagcatcctggcctccagcctgctccggaacgacgtgcccatggcgggccccctggtggccgggggcctgctcatcgcctgctacgtcatcaccgggacctccgccgacctgaccgtggagaaggccgcggacgtgacgtgggaggaggaggccgagcagaccggcgtcagccacaacctgatgatcaccgtggacgacgacgggaccatgcgcatcaaggacgacgagaccgagaacatcctcacggtgctgctgaagaccgccctcctgatcgtctccggcatcttcccgtacagcatccccgccaccctgctcgtgtggcacacctggcagaagcagacgcagcggtccggcgtgctgtgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctcacctacaacgggaagcgcctggagcccaactgggcctccgtgaagaaggacctgatcagctacggcgggggctggcggctctccgcccagtggcagaagggggaggaggtccaggtgatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtcgtggggctgtacggcaacggggtggtcacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtcgtggccgccgagatggaggaggccctcaaggggctgcccatccgctaccagaccacggcgaccaagtccgagcacaccggccgggagatcgtggacctgatgtgccacgccaccttcacgatgcgcctcctgagccccgtccgggtgccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtctggttcgtgcccagcatcaaggcgggcaacgacatcgccaactgcctccggaagaacgggaagaaggtgatccagctgtcccgcaagacgttcgacaccgagtaccagaagaccaagctgaacgactgggacttcgtcgtgaccacggacatcagcgagatgggcgccaacttcaaggccgaccgggtgatcgacccgcgccggtgcctcaagcccgtcatcctgaccgacggccccgagcgcgtgatcctggccgggcccatgccggtgaccgcggcctccgccgcccagcggcgcggccgggtcgggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtcaccgagatcgggcgggtgccctcccacctcgcccaccgcacccggaacgccctggacaacctggtgatgctccacaccagcgagcacggcgggaaggcctaccgccacgcggtcgaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggccgagatcccgctgcagtggatcgccagcgcgatcgtgctggagttcttcatgatggtcctcctgatccccgagcccgagaagcagcggacgccccaggacaaccagctggcctacgtggtgatcgggatcctcaccctggccgccatcatcgccgcgaacgagatgggcctgctcgagaccaccaagcgcgacctgggcatgtccaaggagccgggggtcgtgagccccacgtcctacctggacgtggacctccaccccgccagcgcctggaccctgtacgccgtcgcgaccaccgtgatcacgcccatgctgcggcacaccatcgagaactccaccgccaacgtgagcctcgccgccatcgccaaccaggcggtcgtgctgatgggcctggacaaggggtggccgatctccaagatggacctcggcgtgcccctgctggccctcgggtgctacagccaggtcaaccccctgaccctgacggccgccgtgctcctgctgatcacccactacgccatcatcggccccggcctccaggcgaaggccacccgcgaggcccagaagcggaccgccgccgggatcatgaagaacccgacggtggacggcatcatgaccatcgacctggaccccgtcatctacgactccaagttcgagaagcagctgggccaggtgatgctcctggtgctgtgcgcggtccagctcctgctgatgcgcaccagctgggccctctgcgaggccctgaccctggccacgggccccatcaccaccctctgggagggctcccccgggaagttctggaacaccacgatcgcggtgagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtcgaccgcacggaggcgaaggaggggctgaagcggggcgagatcacccaccacgccgtgagccgcggctccgccaagctgcagtggttcgtggagcggaacatggtcatcccggaggggcgcgtgatcgacctcggctgcgggcggggcgggtggagctactactgcgccggcctgaagaaggtgaccgaggtccgcggctacaccaagggcgggcccgggcacgaggagcccgtgcccatgtccacgtacggctggaacatcgtgaagctgatgagcgggaaggacgtcttctacctcccgcccgagaagtgcgacaccctgctgtgcgacatcggcgagtccagcccctcccccaccgtggaggagagccggaccatccgcgtgctgaagatggtcgagccgtggctcaagaacaaccagttctgcatcaaggtgctgaacccctacatgcccacggtggtcgagcacctggagcgcctccagcggaagcacggcgggatgctggtgcgcaaccccctgtcccggaacagcacccacgagatgtactggatctccaacggcaccgggaacatcgtggccagcgtcaacatggtgtcccgcctcctgctgaaccggttcaccatgacgcaccgccggccgaccatcgagaaggacgtggacctcggcgcgggcacccgccacgtcaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtgaagctgctgaccaagccctgggacgtcgtgcccatggtgacgcagatggcgatgaccgacaccacccccttcgggcagcagcgggtcttcaaggagaaggtggacacgcgcaccccgcggagcatgcccggcacccgccgggtgatgggcatcaccgccgagtggctctggcgcacgctggggcggaacaagaagccccgcctgtgcacccgggaggagttcaccaagaaggtccgcaccaacgccgccatgggcgcggtgttcacggaggagaaccagtgggactccgccaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaccggcaccgtcatggacatcatcagccgcaaggaccagcggggctccggccaggtgggcacgtacgggctgaacaccttcaccaacatggaggcccagctcatccgccagatggagggcgagggggtgctgagcaaggccgacctggagaacccccggctcccggagaagaagatcacccagtggctggagacgaagggcgtcgagcgcctgaagcggatggcgatctccggcgacgactgcgtggtgaagcccatcgacgaccgcttcgccaacgccctcctggccctgaacgacatggggaaggtccggaaggacatcccccagtggcagcccagcaagggctggcacgactggcagcaggtcccgttctgctcccaccacttccacgagctcatcatgaaggacgggcgcaagctggtggtcccctgccggccccaggacgagctgatcggccgcgcccggatcagccagggggcgggctggtccctccgcgagaccgcctgcctgggcaaggcctacgcccagatgtggagcctgatgtacttccaccgccgggacctccgcctggcgtccaacgccatctgcagcgccgtgcccgtgcactgggtcccgacctcccggaccacgtggagcatccacgcccaccaccagtggatgaccaccgaggacatgctgaccgtgtggaaccgcgtgtggatcgaggacaacccctggatggaggacaagacgcccgtcaccacctgggagaacgtgccctacctcgggaagcgggaggaccagtggtgcggcagcctgatcgggctgacctcccgcgccacgtgggcgcagaacatcccgaccgccatccagcaggtccggagcctcatcggcaacgaggagttcctggactacatgccctccatgaagcgcttccggaaggaggaggagagcgagggggccatctggtga

SEQ ID NO: 10280 - RNA, 9873 nt, synthetic construct
  misc_feature 1..9873: note = derived and/or modified CDS sequence (opt1) from DENV-3__FJ898469__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggctccagggcgagaccctgggggagaagtggaagaagaagctgaaccagctctcccggaaggagttcgacctgtacaagaagtccggcatcacggaggtggaccgcaccgaggcgaaggaggggctgaagcggggcgagatcacccaccacgccgtcagccgcggctccgccaagctccagtggttcgtggagcggaacatggtgatcccggaggggcgcgtcatcgacctgggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctcatgagcgggaaggacgtgttctacctgccgcccgagaagtgcgacaccctgctgtgcgacatcggcgagtccagcccctcccccaccgtcgaggagagccggacgatccgcgtgctcaagatggtggagccgtggctgaagaacaaccagttctgcatcaaggtcctgaacccctacatgcccaccgtgatcgagcacctcgagcgcctgcagcggaagcacggcgggatgctggtgcgcaaccccctctcccggaacagcacccacgagatgtactggatctccaacggcaccgggaacatcgtcgccagcgtgaacatggtgtcccgcctgctgctcaaccggttcacgatgacccaccgccggccgaccatcgagaaggacgtcgacctgggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctcacgaagccctgggacgtggtgcccatggtcacccagatggcgatgaccgacaccacgcccttcgggcagcagcgggtgttcaaggagaaggtggacacccgcaccccgcggtccatgcccggcacccgccgggtcatgggcatcacggccgagtggctgtggcgcaccctggggcggaacaagaagccccgcctctgcacccgggaggagttcaccaagaaggtgcgcacgaacgccgccatgggcgcggtgttcaccgaggagaaccagtgggacagcgccaaggccgccgtcgaggacgaggacttctggaagctggtggaccgcgagcgggagctgcacaagctcgggaagtgcggcagctgcgtgtacaacatgatggggaagcgcgagaagaagctgggcgagttcggcaaggccaaggggtcccgggcgatctggtacatgtggctgggcgcccgctacctcgagttcgaggccctggggttcctgaacgaggaccactggttcagccgggagaactcctacagcggcgtcgagggggagggcctccacaagctgggctacatcctgcgcgacatctccaagatccccgggggcgccatgtacgccgacgacaccgcggggtgggacacccggatcacggaggacgacctccacaacgaggagaagatcacccagcagatggacccggagcaccgccagctggccaacgccatcttcaagctgacctaccagaacaaggtggtgaaggtccagcggcccacccccaccggcacggtgatggacatcatcagccgcaaggaccagcggggctccggccaggtgggcacctacgggctcaacaccttcaccaacatggaggcccagctgatccgccagatggagggcgagggggtcctgagcaaggccgacctcgagaacccccacctccccgagaagaagatcacgcagtggctggagaccaagggcgtggagcggctgaagcgcatggcgatctccggcgacgactgcgtggtcaagcccatcgacgaccggttcgccaacgccctgctggccctcaacgacatggggaaggtgcgcaaggacatcccccagtggcagcccagcaagggctggcacgactggcagcaggtcccgttctgctcccaccacttccacgagctgatcatgaaggacgggcggaagctggtcgtgccctgccgcccccaggacgagctcatcggccgggcccgcatcagccagggggcgggctggtccctgcgggagaccgcctgcctgggcaaggcctacgcccagatgtggagcctcatgtacttccaccgccgcgacctgcggctggcgtccaacgccatctgcagcgccgtgcccgtccactgggtgccgacctcccgcacgacctggagcatccacgcccaccaccagtggatgaccaccgaggacatgctcacggtgtggaaccgggtctggatcgaggacaacccctggatggaggacaagacccccgtgaccacctgggagaacgtgccctacctggggaagcgcgaggaccagtggtgcggctccctgatcgggctcacgagccgggccacctgggcgcagaacatcccgaccgccatccagcaggtccgcagcctgatcggcaacgaggagttcctggactacatgccctccatgaagcggttccgcaaggaggaggagagcgagggggccatctggtga

SEQ ID NO: 10281 - RNA, 9873 nt, synthetic construct
  misc_feature 1..9873: note = derived and/or modified CDS sequence (opt1) from DENV-3__FJ898470__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtccccacccacctcgcccaccgcacccggaacgccctggacaacctggtgatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtcatcgcctccagcggcatgctctggatggccgagatcccgctgcagtggatcgcctccgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgagcaaggagccgggggtggtctcccccaccagctacctggacgtggacctccaccccgcctccgcctggaccctgtacgccgtggcgaccacggtcatcacccccatgctgcggcacaccatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgacagcaagttcgagaagcagctggggcaggtcatgctcctggtgctgtgcgcggtgcagctcctgctgatgcgcacctcctgggccctctgcgaggccctgacgctggccaccggccccatcaccaccctctgggagggcagccccgggaagttctggaacacgaccatcgcggtctccatggccaacatcttccggggcagctacctggccggggccggcctggccttctccatcatgaagtccgtggggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtctcccgcggcagcgccaagctgcagtggttcgtggagcggaacatggtgatcccggaggggcgcgtcatcgacctcggctgcgggcggggcgggtggtcctactactgcgccggcctgaagaaggtgaccgaggtgcgcggctacacgaagggcgggcccgggcacgaggagcccgtccccatgagcacctacggctggaacatcgtgaagctgatgtccgggaaggacgtgttctacctcccgcccgagaagtgcgacaccctgctgtgcgacatcggcgagagctcccccagccccaccgtcgaggagtcccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgagccggaactccacccacgagatgtactggatcagcaacggcaccgggaacatcgtcgcctccgtgaacatggtgagccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagctccatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctcgtggaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtcgagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccgccggcaccgtgatggacatcatctcccgcaaggaccagcggggcagcggccaggtgggcacgtacgggctgaacaccttcaccaacatggaggcccagctcatccgccagatggagggcgagggggtcctgtccaaggcggacctggagaacccccacctcccggagaagaagatcacccagtggctggagacgaagggcgtggagcggctgaagcgcatggccatcagcggcgacgactgcgtggtcaagcccatcgacgaccggttcgccaacgccctcctggccctgaacgacatggggaaggtgcgcaaggacatcccccagtggcagccctccaagggctggcacgactggcagcaggtcccgttctgcagccaccacttccacgagctcatcatgaaggacgggcggaagctggtcgtgccctgccgcccccaggacgagctgatcggccgggcgcgcatctcccagggggccggctggagcctccgggagaccgcctgcctgggcaaggcctacgcgcagatgtggtccctgatgtacttccaccgccgcgacctccggctggccagcaacgccatctgctccgccgtgcccgtccactgggtgccgaccagccgcaccacgtggtccatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgaccagccgggcgacgtgggcccagaacatcccgaccgccatccagcaggtccgctccctcatcggcaacgaggagttcctggactacatgcccagcatgaagcggttccgcaaggaggaggagtccgagggggccatctggtga

SEQ ID NO: 10282 - RNA, 9873 nt, synthetic construct
  misc_feature 1..9873: note = derived and/or modified CDS sequence (opt1) from DENV-3__FJ898471__SS-prME
  source 1..9873: mol_type = other RNA
accagcctctgcctcatgatgatcctgcccgcggcgctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacctgggccctgcgccacccggggttcaccatcctcgcgctgttcctggcccactacatcggcacctccctcatccagaaggtggtgatcttcatcctgctgatgctcgtgacccccagcatgacgatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggccacccagctggcgaccctccggaagctgtgcatcgagggcaagatcacgaacatcaccaccgacagccgctgccccacccagggcgaggccgtgctgccggaggagcaggaccagaactacgtctgcaagcacacgtacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcaccgtccacacgggggaccagcaccaggtgggcaacgagacccagggggtcaccgccgagatcacgccccaggccagcacgaccgaggcgatcctgcccgagtacggcaccctggggctcgagtgctccccgcgcaccggcctggacttcaacgagatgatcctgctcaccatgaagaacaaggcctggatggtgcaccggcagtggttcttcgacctgcccctgccctggacgagcggcgccaccaccgagacccccacgtggaaccgcaaggagctcctggtgaccttcaagaacgcccacgccaagaagcaggaggtcgtggtgctggggtcccaggagggcgcgatgcacaccgccctcaccggggccacggagatccagaacagcggcgggacctccatcttcgccggccacctgaagtgccggctgaagatggacaagctcgagctgaagggcatgagctacgccatgtgcaccaacaccttcgtcctgaagaaggaggtgtccgagacgcagcacgggaccatcctcatcaaggtggagtacaagggcgaggacgtcccgtgcaagatccccttcagcaccgaggacgggcagggcaaggcgcacaacggccgcctgatcaccgccaaccccgtggtgacgaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacgtggatcggcctgaacagcaagaacacctccatgagcttctcctgcatcgtgatcgggatcatcaccctctacctgggcgccgtcgtgcaggccgacatggggtgcgtgatcaactggaagggcaaggagctgaagtgcggcagcgggatcttcgtcaccaacgaggtgcacacgtggaccgagcagtacaagttccaggccgactcccccaagcgcctcgcgaccgccatcgccggcgcctgggagaacggggtgtgcggcatccgcagcaccacgcggatggagaacctgctgtggaagcagatcgccaacgagctcaactacatcctgtgggagaacaacatcaagctgaccgtcgtggtgggggacatcatcggcgtcctcgagcagggcaagcgcaccctgacgccccagccgatggagctgaagtactcctggaagacgtgggggaaggcgaagatcgtgaccgccgagacccagaacagctccttcatcatcgacggccccaacacccccgagtgccccagcgcctcccgggcctggaacgtgtgggaggtcgaggactacgggttcggcgtgttcacgaccaacatctggctcaagctgcgcgaggtgtacacccagctgtgcgaccaccggctcatgagcgcggccgtcaaggacgagcgcgccgtgcacgccgacatgggctactggatcgagagccagaagaacgggtcctggaagctggagaaggccagcctgatcgaggtgaagacctgcacctggccgaagtcccacacgctctggagcaacggcgtcctggagtccgacatgatcatccccaagagcctggcggggcccatctcccagcacaactaccggccgggctaccacacccagaccgccgggccctggcacctcggcaagctggagctggacttcaactactgcgagggcaccacggtggtgatcaccgagaactgcgggacccgcggccccagcctccggaccacgaccgtctccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtcgacaacttcaccatgggcgtgctgtgcctcgccatcctgttcgaggaggtgatgcgggggaagttcggcaagaagcacatgatcgccggggtcttcttcacgttcgtgctgctcctgtccggccagatcacctggcgcgacatggcgcacaccctgatcatgatcggcagcaacgcctccgaccggatggggatgggcgtgacctacctcgccctgatcgccacgttcaagatccagcccttcctggccctcgggttcttcctgcgcaagctgaccagccgggagaacctcctgctgggcgtcggcctcgcgatggccaccaccctgcagctgcccgaggacatcgagcagatggccaacgggatcgccctcggcctgatggcgctgaagctcatcacgcagttcgagacctaccagctgtggaccgccctggtgagcctgacctgctccaacacgatcttcaccctgaccgtcgcctggcgcaccgccacgctgatcctcgccggggtgagcctgctgccggtgtgccagtccagctccatgcggaagaccgactggctccccatgaccgtcgcggccatgggcgtgccgcccctcccgctgttcatcttcagcctcaaggacaccctgaagcgccgctcctggcccctgaacgagggggtgatggccgtcggcctcgtgagcatcctggcctccagcctgctccggaacgacgtgcccatggccggccccctggtcgccggcgggctgctcatcgcctgctacgtgatcacggggacctccgccgacctgaccgtggagaaggccgccgacgtcacctgggaggaggaggcggagcagacgggggtgagccacaacctgatgatcaccgtggacgacgacgggaccatgcgcatcaaggacgacgagaccgagaacatcctcaccgtcctgctgaagacggccctcctgatcgtgtccggcatcttcccgtacagcatccccgccaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggcgtccgtcaagaaggacctgatcagctacggcgggggctggcggctctccgcccagtggcagaagggggaggaggtccaggtgatcgccgtcgagcccggcaagaaccccaagaacttccagaccatgcccggcaccttccagaccacgaccggggagatcggcgccatcgcgctggacttcaagcccgggaccagcggcagccccatcatcaaccgcgagggcaaggtggtggggctgtacggcaacggggtcgtgaccaagaacggcgggtacgtgtccggcatcgcccagacgaacgccgagccggacggccccacccccgagctggaggaggagatgttcaagaagcggaacctcaccatcatggacctgcaccccgggagcggcaagacccgcaagtacctgccggccatcgtccgggaggccatcaagcgccggctccgcacgctgatcctggcgcccacccgggtggtggccgccgagatggaggaggccctcaaggggctgcccatccgctaccagaccaccgccacgaagtccgagcacaccggccgggagatcgtcgacctgatgtgccacgcgaccttcaccatgcgcctcctgagccccgtgcgggtgccgaactacaacctgatcatcatggacgaggcccacttcacggaccccgcctccatcgccgcccgcgggtacatcagcacccgggtcggcatgggcgaggcggccgccatcttcatgaccgccacgccgcccgggacggcggacgccttcccgcagtccaacgcccccatccaggacgaggagcgcgacatccccgagcgcagctggaactccggcaacgagtggatcaccgacttcgccgggaagaccgtgtggttcgtgcccagcatcaaggccggcaacgacatcgcgaactgcctccggaagaacgggaagaaggtcatccagctgtcccgcaagaccttcgacacggagtaccagaagaccaagctgaacgactgggacttcgtggtgaccaccgacatcagcgagatgggcgccaacttcaaggccgaccgggtcatcgacccgcgccggtgcctcaagcccgtgatcctgacggacggccccgagcgcgtgatcctggccgggcccatgccggtcaccgccgcgtccgccgcccagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgaagggcgagtcccggaagacgttcgtcgagctgatgcgccgcggggacctccccgtgtggctggcctacaaggtggcgagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacctactccgacccgctggccctcaaggagttcaaggacttcgccgccggccgcaagagcatcgcgctggacctggtgacggagatcgggcgggtgccctcccacctcgcccaccgcacccggaacgccctggacaacctggtcatgctccacaccagcgagcacggcgggaaggcctaccgccacgccgtggaggagctgcccgagaccatggagacgctgctcctgctgggcctcatgatcctgctgaccgggggcgcgatgctgttcctgatcagcggcaaggggatcggcaagacctccatcgggctgatctgcgtgatcgccagctccggcatgctctggatggccgagatcccgctgcagtggatcgccagcgccatcgtcctggagttcttcatgatggtgctcctgatccccgagcccgagaagcagcggacgccccaggacaaccagctggcgtacgtggtcatcgggatcctcacgctggccgccatcatcgccgccaacgagatgggcctgctcgagaccaccaagcgcgacctgggcatgtccaaggagccgggggtggtgagccccacctcctacctggacgtcgacctccaccccgcgagcgcctggacgctgtacgccgtggccaccaccgtgatcacccccatgctgcggcacacgatcgagaactccaccgcgaacgtcagcctcgccgccatcgccaaccaggccgtggtgctgatgggcctggacaaggggtggccgatctccaagatggacctcggcgtccccctgctggcgctcgggtgctacagccaggtgaaccccctgaccctgaccgccgccgtgctcctgctgatcacgcactacgccatcatcggccccggcctccaggccaaggcgacccgcgaggcccagaagcggaccgccgccgggatcatgaagaacccgaccgtcgacggcatcatgacgatcgacctggaccccgtgatctacgactccaagttcgagaagcagctgggccaggtgatgctcctggtcctgtgcgccgtgcagctcctgctgatgcgcaccagctgggcgctctgcgaggccctgaccctggccaccggccccatcacgaccctctgggagggctcccccgggaagttctggaacaccaccatcgccgtgagcatggcgaacatcttccggggctcctacctggccggggccggcctggccttcagcatcatgaagtccgtcgggacgggcaagcgcggcaccgggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagatcacgcaccacgcggtgagccgcggctccgccaagctgcagtggttcgtcgagcggaacatggtgatcccggaggggcgcgtgatcgacctcggctgcgggcggggcgggtggagctactactgcgccggcctgaagaaggtcaccgaggtgcgcggctacaccaagggcgggcccgggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccggaccatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtggccagcgtcaacatggtgtcccgcctcctgctgaaccggttcaccatgacccaccgccggccgacgatcgagaaggacgtggacctcggcgccggcacccgccacgtcaacgcggagcccgagacccccaacatggacgtgatcggggagcggatcaagcgcatcaaggaggagcacaacagcacctggcactacgacgacgagaacccgtacaagacgtgggcctaccacggctcctacgaggtcaaggccaccgggagcgcctccagcatgatcaacggcgtggtgaagctgctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgcggagtggctctggcgcaccctggggcggaacaagaagccccgcctgtgcacgcgggaggagttcaccaagaaggtccgcaccaacgccgccatgggcgccgtgttcaccgaggagaaccagtgggactccgcgaaggccgccgtggaggacgaggacttctggaagctcgtcgaccgcgagcgggagctgcacaagctggggaagtgcggcagctgcgtgtacaacatgatggggaagcgcgagaagaagctcggcgagttcggcaaggccaaggggtcccgggccatctggtacatgtggctgggcgcgcgctacctggagttcgaggccctcgggttcctgaacgaggaccactggttcagccgggagaactcctacagcggcgtggagggggagggcctgcacaagctcggctacatcctgcgcgacatctccaagatccccgggggcgccatgtacgccgacgacacggccgggtgggacacccggatcaccgaggacgacctgcacaacgaggagaagatcacccagcagatggacccggagcaccgccagctcgcgaacgccatcttcaagctgacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcccagctcatccgccagatggagggcgagggggtgctgagcaaggccgacctggagaacccccacctcccggagaagaagatcacccagtggctggagaccaagggcgtcgagcggctgaagcgcatggccatctccggcgacgactgcgtggtgaagcccatcgacgaccggttcgcgaacgccctcctggccctgaacgacatggggaaggtccgcaaggacatcccccagtggcagcccagcaagggctggcacgactggcagcaggtcccgttctgctcccaccacttccacgagctcatcatgaaggacgggcggaagctggtggtcccctgccgcccccaggacgagctgatcggccgggcccgcatcagccagggggccggctggtccctccgggagacggcgtgcctgggcaaggcctacgcccagatgtggagcctgatgtacttccaccgccgcgacctccggctggcctccaacgcgatctgcagcgccgtgcccgtgcactgggtcccgacctcccgcaccacctggagcatccacgcccaccaccagtggatgacgaccgaggacatgctgaccgtgtggaaccgggtgtggatcgaggacaacccctggatggaggacaagacccccgtcacgacctgggagaacgtgccctacctcgggaagcgcgaggaccagtggtgcggcagcctgatcgggctgacctcccgggccacctgggcccagaacatcccgacggcgatccagcaggtccgcagcctcatcggcaacgaggagttcctggactacatgccctccatgaagcggttccgcaaggaggaggagagcgagggggccatctggtga

SEQ ID NO: 10283 - RNA, 9873 nt, synthetic construct
  misc_feature 1..9873: note = derived and/or modified CDS sequence (opt1) from DENV-3__FJ898472__SS-prME
  source 1..9873: mol_type = other RNA
accagcctgtgcctcatgatgatcctgcccgccgccctggcgttccacctcacctcccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcctgaccttcgtcctcctgctgtccggccagatcacctggcgcgacatggcccacaccctcatcatgatcggcagcaacgcctccgaccggatggggatgggcgtgacgtacctggccctgatcgccaccttcaagatccagcccttcctcgcgctggggttcttcctgcgcaagctcaccagccgggagaacctgctgctcggcgtgggcctggccatggccaccacgctgcagctccccgaggacatcgagcagatggccaacgggatcgcgctgggcctgatggccctcaagctgatcacccagttcgagacctaccagctgtggaccgccctcatcagcctgacgtgctccaacaccatcttcaccctgaccgtcgcctggcgcacggccaccctcatcctggcgggggtgagcctgctcccggtctgccagtccagctccatgcggaagaccgactggctgcccatgaccgtggccgccatgggcgtgccgcccctgcccctgttcatcttcaacctgaaggacacgctgaagcgccgcagctggcccctcaacgagggggtcatggccgtgggcctggtgtccatcctggccagctccctcctgcggaacgacgtccccatggcgggccccctggtggccgggggcctcctgatcgcctgctacgtgatcaccgggaccagcgccgacctgaccgtcgagaaggccgcggacgtgacgtgggaggaggaggccgagcagaccggcgtgtcccacaacctcatgatcaccgtcgacgacgacgggaccatgcgcatcaaggacgacgagaccgagaacatcctgacggtgctgctcaagaccgccctgctgatcgtgagcggcatcttcccgtactccatccccgccaccctcctggtctggcacacctggcagaagcagacgcagcggagcggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacgcggggcgcggtcctgacctacaacgggaagcgcctggagcccaactgggccagcgtgaagaaggacctcatctcctacggcgggggctggcggctgagcgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggacctccggcagccccatcatcaaccgcgagggcaaggtggtcgggctgtacggcaacggggtggtgacgaagaacggcgggtacgtcagcggcatcgcccagaccaacgccgagccggacggccccacccccgagctcgaggaggagatgttcaagaagcggaacctgaccatcatggacctgcaccccgggtccggcaagacgcgcaagtacctcccggccatcgtgcgggaggcgatcaagcgccggctgcgcaccctgatcctcgcccccacccgggtggtcgccgccgagatggaggaggccctgaaggggctgcccatccgctaccagaccacggcgaccaagagcgagcacaccggccgggagatcgtggacctcatgtgccacgccaccttcacgatgcgcctgctgtcccccgtgcgggtcccgaactacaacctcatcatcatggacgaggcccacttcaccgaccccgccagcatcgccgcgcgcgggtacatctccacccgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcaccgacttcgccgggaagaccgtgtggttcgtcccctccatcaaggcgggcaacgacatcgccaactgcctgcggaagaacgggaagaaggtgatccagctgagccgcaagacgttcgacaccgagtaccagaagaccaagctcaacgactgggacttcgtggtcaccacggacatctccgagatgggcgccaacttcaaggccgaccgggtgatcgacccgcgccggtgcctgaagcccgtgatcctgaccgacggccccgagcgcgtcatcctcgccgggcccatgccggtgaccgcggccagcgccgcccagcggcgcggccgggtggggcgcaacccccagaaggagaacgaccagtacatcttcaccggccagcccctgaacaacgacgaggaccacgcccactggaccgaggcgaagatgctgctcgacaacatcaacacgcccgaggggatcatcccggccctgttcgagcccgagcgggagaagtccgccgccatcgacggcgagtaccgcctgaagggcgagagccggaagaccttcgtcgagctcatgcgccgcggggacctgcccgtgtggctggcgcacaaggtcgcctccgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacgtacagcgacccgctcgccctgaaggagttcaaggacttcgccgcgggccgcaagtccatcgccctggacctcgtgaccgagatcgggcgggtccccacccacctggcccaccgcacccggaacgccctggacaacctcgtgatgctgcacacgagcgagcacggcgggaaggcctaccgccacgcggtggaggagctgcccgagaccatggagaccctcctgctgctcggcctgatgatcctgctcaccgggggcgccatgctgttcctgatctccggcaaggggatcggcaagacgagcatcgggctcatctgcgtcatcgccagctccggcatgctgtggatggccgagatcccgctgcagtggatcgccagcgcgatcgtgctcgagttcttcatgatggtgctgctgatccccgagcccgagaagcagcggacgccccaggacaaccagctcgcctacgtcgtgatcgggatcctgaccctggccgccatcatcgccgcgaacgagatgggcctcctggagaccacgaagcgcgacctgggcatgtccaaggagccgggggtggtcagccccacctcctacctcgacgtggacctgcaccccgccagcgcctggaccctgtacgccgtggcgaccacggtcatcacccccatgctccggcacaccatcgagaactccaccgccaacgtgagcctggccgccatcgccaaccaggcggtggtcctgatgggcctcgacaaggggtggccgatctccaagatggacctgggcgtgcccctgctcgccctggggtgctacagccaggtgaaccccctgacgctcaccgccgccgtcctgctgctcatcacccactacgccatcatcggccccggcctgcaggcgaaggccacccgcgaggcccagaagcggacggccgccgggatcatgaagaacccgaccgtggacggcatcatgaccatcgacctggaccccgtgatctacgactccaagttcgagaagcagctcgggcaggtcatgctgctggtgctctgcgcggtgcagctgctgctcatgcgcaccagctgggccctgtgcgaggccctgacgctcgccaccggccccatcaccaccctgtgggagggctcccccgggaagttctggaacacgaccatcgcggtcagcatggccaacatcttccggggctcctacctggccggggccggcctcgccttcagcatcatgaagtccgtggggaccggcaagcgcggcaccgggagccagggcgagaccctgggggagaagtggaagaagaagctgaaccagctctcccggaaggagttcgacctgtacaagaagtccggcatcacggaggtggaccgcaccgaggcgaaggaggggctgaagcggggcgagatcacccaccacgccgtcagccgcggctccgccaagctccagtggttcgtggagcggaacatggtgatcccggaggggcgcgtcatcgacctgggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctcatgagcgggaaggacgtgttctacctgccgcccgagaagtgcgacaccctgctgtgcgacatcggcgagtccagcccctcccccaccgtcgaggagagccggacgatccgcgtgctcaagatggtggagccgtggctgaagaacaaccagttctgcatcaaggtcctgaacccctacatgcccaccgtgatcgagcacctcgagcgcctgcagcggaagcacggcgggatgctggtgcgcaaccccctctcccggaacagcacccacgagatgtactggatctccaacggcaccgggaacatcgtcgccagcgtgaacatggtgtcccgcctgctgctcaaccggttcacgatgacccaccgccggccgaccatcgagaaggacgtcgacctgggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctcacgaagccctgggacgtggtgcccatggtcacccagatggcgatgaccgacaccacgcccttcgggcagcagcgggtgttcaaggagaaggtggacacccgcaccccgcggtccatgcccggcacccgccgggtcatgggcatcacggccgagtggctgtggcgcaccctggggcggaacaagaagccccgcctctgcacccgggaggagttcaccaagaaggtgcgcacgaacgccgccatgggcgcggtgttcaccgaggagaaccagtgggacagcgccaaggccgccgtcgaggacgaggacttctggaagctggtggaccgcgagcgggagctgcacaagctcgggaagtgcggcagctgcgtgtacaacatgatggggaagcgcgagaagaagctgggcgagttcggcaaggccaaggggtcccgggcgatctggtacatgtggctgggcgcccgctacctcgagttcgaggccctggggttcctgaacgaggaccactggttcagccgggagaactcctacagcggcgtcgagggggagggcctccacaagctgggctacatcctgcgcgacatctccaagatccccgggggcgccatgtacgccgacgacaccgcggggtgggacacccggatcacggaggacgacctccacaacgaggagaagatcacccagcagatggacccggagcaccgccagctggccaacgccatcttcaagctgacctaccagaacaaggtggtgaaggtccagcggcccacccccaccggcacggtgatggacatcatcagccgcaaggaccagcggggctccggccaggtgggcacctacgggctcaacaccttcaccaacatggaggcccagctgatccgccagatggagggcgagggggtcctgagcaaggccgacctcgagaacccccacctcccggagaagaagatcacgcagtggctggagaccaagggcgtggagcggctcaagcgcatggcgatctccggcgacgactgcgtggtcaagcccatcgacgaccggttcgccaacgccctgctggccctcaacgacatggggaaggtgcgcaaggacatcccccagtggcagcccagcaagggctggcacgactggcagcaggtcccgttctgctcccaccacttccacgagctgatcatgaaggacgggcggaagctggtcgtgccctgccgcccccaggacgagctcatcggccgggcccgcatcagccagggggcgggctggtccctgcgggagaccgcctgcctgggcaaggcctacgcccagatgtggagcctcatgtacttccaccgccgcgacctgcggctggcgtccaacgccatctgcagcgccgtgcccgtccactgggtgccgacctcccgcacgacctggagcatccacgcccaccaccagtggatgaccaccgaggacatgctcacggtgtggaaccgggtctggatcgaggacaacccctggatggaggacaagacccccgtgaccacctgggagaacgtgccctacctggggaagcgcgaggaccagtggtgcggctccctgatcgggctcacgagccgggccacctgggcgcagaacatcccgaccgccatccagcaggtccgcagcctgatcggcaacgaggagttcctggactacatgccctccatgaagcggttccgcaaggaggaggagagcgagggggccatctggtga

SEQ ID NO: 10284 - RNA, 9873 nt, synthetic construct
  misc_feature 1..9873: note = derived and/or modified CDS sequence (opt1) from DENV-3__FJ898474__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggcgagcaccaccgaggccatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgcgaagaagcaggaggtggtcgtgctggggtcccaggagggcgccatgcacaccgccctcacgggggccaccgagatccagaacagcggcgggacctccatcttcgccggccacctgaagtgccggctgaagatggacaagctcgagctgaagggcatgagctacgcgatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccccagccgatggagctgaagtactcctggaagacctgggggaaggccaagatcatgaccgccgagacccagaacagctccttcatcatcgacggccccaacacgcccgagtgccccagcgcgtcccgggcctggaacgtgtgggaggtcgaggactacgggttcggcgtgttcaccaccaacatctggctcaagctgcgcgaggtgtacacccagctgtgcgaccaccggctcatgagcgccgccatcaaggacgagcgcgccgtccacgcggacatgggctactggatcgagagccagaagaacgggtcctggaagctggagaaggccagcctgatcgaggtgaagacctgcacgtggccgaagtcccacaccctctggagcaacggcgtgctggagtccgacatgatcatccccaaggggctggccggccccatcagccagcacaaccaccggccggggtaccacacccagaccgccggcccctggcacctcggcaagctggagctggacttcaactactgcgaggggacgaccgtcgtgatcaccgagaactgcggcacccgcgggccctccctccggacgaccaccgtgagcggcaagctgatccacgagtggtgctgccgctcctgcaccctgcccccgctccggtacatcggggaggacggctgctggtacggcatggagatccgccccatcagcgagaaggaggagaacatggtcaagtccctggtgagcgccgggtccggcaaggtggacaacttcacgatgggggtcctgtgcctcgcgatcctgttcgaggaggtgatgcggggcaagttcgggaagaagcacatgatcgccggcgtgttcttcaccttcgtcctgctcctgagcggccagatcacctggcgcgacatggcccacaccctgatcatgatcgggtccaacgccagcgaccggatgggcatgggggtgacgtacctcgccctgatcgcgaccttcaagatccagcccttcctggccctcggcttcttcctgcgcaagctgacctcccgggagaacctcctgctgggcgtggggctcgccatggccaccacgctgcagctgcccgaggacatcgagcagatggcgaacggcatcgccctcgggctgatggccctgaagctcatcacccagttcgagacctaccagctgtggaccgccctgatcagcctcacgtgcagcaacaccatcttcaccctgaccgtcgcctggcgcacggcgaccctgatcctcgccggcgtgtccctgctgccggtgtgccagagctccagcatgcggaagaccgactggctccccatggccgtcgccgccatgggggtgccgcccctcccgctgttcatcttctccctcaaggacaccctgaagcgccgcagctggcccctgaacgagggcgtcatggcggtgggcctcgtgtccatcctggccagctccctgctccggaacgacgtccccatggccgggcccctggtggccggcgggctgctcatcgcctgctacgtgatcacgggcaccagcgcggacctgaccgtcgagaaggccgccgacatcacctgggaggaggaggccgagcagacgggggtgtcccacaacctgatgatcaccgtggacgacgacggcaccatgcgcatcaaggacgacgagaccgagaacatcctcaccgtcctgctgaagacggccctcctgatcgtgagcggcatcttcccgtactccatccccgcgaccctgctcgtgtggcacacctggcagaagcagacccagcggagcggggtcctgtgggacgtgcccagcccgcccgagacgcagaaggccgagctggaggagggcgtgtaccgcatcaagcagcaggggatcttcggcaagacccaggtcggggtgggcgtgcagaaggagggcgtcttccacaccatgtggcacgtgacccgcggggccgtgctcacgtacaacggcaagcgcctggagcccaactgggccagcgtcaagaaggacctgatctcctacgggggcgggtggcggctcagcgcgcagtggcagaagggcgaggaggtccaggtgatcgccgtcgagcccggcaagaaccccaagaacttccagaccatgcccgggaccttccagaccatcacgggcgagatcggggccatcgccctggacttcaagcccggcacctccggcagccccatcatcaaccgcgaggggaaggtggtgggcctgtacgggaacggcgtcgtgaccaagaacgggggctacgtgagcggcatcgcccagaccaacgcggagccggacgggcccacgcccgagctggaggaggagatgttcaagaagcggaacctcaccatcatggacctgcaccccggctccgggaagacccgcaagtacctgccggccatcgtccgggaggccatcaagcgccggctccgcaccctgatcctggcccccacgcgggtggtggccgcggagatggaggaggccctcaagggcctgcccatccgctaccagaccaccgccaccaagagcgagcacacggggcgggagatcgtcgacctgatgtgccacgccaccttcaccatgcgcctcctgtcccccgtgcgggtgccgaactacaacctgatcatcatggacgaggcccacttcaccgaccccgcgagcatcgccgcccgcggctacatctccacgcgggtcggcatgggggaggccgcggccatcttcatgaccgccacgccgcccggcaccgccgacgccttcccgcagagcaacgcgcccatccaggacgaggagcgcgacatccccgagcgctcctggaacagcgggaacgagtggatcacggacttcgccggcaagaccgtgtggttcgtgccctccatcaaggccgggaacgacatcgccaactgcctccggaagaacggcaagaaggtcatccagctgagccgcaagaccttcgacaccgagtaccagaagacgaagctgaacgactgggacttcgtggtgaccaccgacatctccgagatgggcgccaacttcaaggcggaccgggtcatcgacccgcgccggtgcctcaagcccgtgatcctgaccgacgggcccgagcgcgtgatcctggccggccccatgccggtcacggccgccagcgccgcgcagcggcgcgggcgggtgggccgcaacccccagaaggagaacgaccagtacatcttcaccgggcagcccctcaacaacgacgaggaccacgcccactggaccgaggccaagatgctgctggacaacatcaacacccccgagggcatcatcccggccctcttcgagcccgagcgggagaagtccgcggccatcgacggcgagtaccgcctgaagggggagagccggaagaccttcgtggagctgatgcgccggggcgacctccccgtctggctggcccacaaggtggcctccgaggggatcaagtacacggaccgcaagtggtgcttcgacggccagcggaacaaccagatcctggaggagaacatggacgtggagatctggaccaaggagggcgagaagaagaagctccgcccccggtggctggacgcccgcacctacagcgacccgctggcgctcaaggagttcaaggacttcgccgccgggcgcaagtccatcgccctggacctggtcaccgagatcggccgggtgcccagccacctcgcccaccgcacgcggaacgcgctggacaacctggtcatgctccacacctccgagcacgggggccgcgcctaccggcacgccgtggaggagctgcccgagaccatggagaccctgctcctgctggggctcatgatcctgctgacgggcggcgccatgctgttcctgatcagcgggaagggcatcgggaagaccagcatcggcctgatctgcgtgatcgcctccagcgggatgctctggatggcggagatcccgctgcagtggatcgcctccgccatcgtcctggagttcttcatgatggtgctcctgatccccgagcccgagaagcagcgcacgccccaggacaaccagctggcctacgtggtcatcggcatcctcaccctggccgcgatcatcgccgccaacgagatgggcctgctcgagacgaccaagcgggacctggggatgagcaaggagccgggcgtggtgtcccccaccagctacctggacgtcgacctccaccccgcctccgcgtggaccctgtacgccgtggccacgaccgtgatcacccccatgctgcgccacaccatcgagaacagcacggccaacgtctccctcgccgcgatcgccaaccaggccgtggtgctgatggggctggacaagggctggccgatcagcaagatggacctcggggtccccctgctggccctcggctgctactcccaggtgaaccccctgaccctgaccgccgcggtgctcctgctgatcacccactacgccatcatcggccccgggctccaggccaaggccacgcgggaggcccagaagcgcaccgcggccggcatcatgaagaacccgaccgtcgacgggatcatgaccatcgacctggaccccgtgatctacgacagcaagttcgagaagcagctgggccaggtgatgctcctggtcctgtgcgccgtgcagctcctgctgatgcggacgtcctgggccctctgcgaggcgctgaccctggccaccggccccatcaccacgctctgggaggggagccccggcaagttctggaacaccaccatcgccgtgtccatggccaacatcttccgcgggagctacctggccggcgcggggctggccttctccatcatgaagtccgtcggcaccggcaagcgggggacgggctcccagggggagaccctcggcgagaagtggaagaagaagctgaaccagctgagccgcaaggagttcgacctctacaagaagtccgggatcaccgaggtggaccggaccgaggccaaggagggcctgaagcgcggcgagaccacgcaccacgccgtgtcccgggggagcgccaagctgcagtggttcgtcgagcgcaacatggtgatcccggagggccgggtgatcgacctcgggtgcggccgcgggggctggtcctactactgcgcgggcctgaagaaggtcaccgaggtgcgggggtacaccaagggcgggcccggccacgaggagcccgtgcccatgagcacctacgggtggaacatcgtcaagctgatgtccggcaaggacgtgttctacctcccgcccgagaagtgcgacacgctgctgtgcgacatcggcgagagctcccccagccccaccgtggaggagtcccgcaccatccgcgtcctgaagatggtggagccgtggctcaagaacaaccagttctgcatcaaggtgctgaacccctacatgcccaccgtcatcgagcacctggagcggctccagcgcaagcacgggggcatgctggtgcggaaccccctgagccgcaactccacgcacgagatgtactggatcagcaacgggaccggcaacatcgtggcctccgtcaacatggtgagccggctcctgctgaaccgcttcaccatgacccaccggcgcccgacgatcgagaaggacgtggacctcggcgccgggacccggcacgtcaacgccgagcccgagacccccaacatggacgtgatcggcgagcgcatcaagcggatcaaggaggagcacaactccacctggcactacgacgacgagaacccgtacaagacgtgggcctaccacgggagctacgaggtgaaggcgaccggctccgccagctccatgatcaacggggtcgtgaagctgctgaccaagccctgggacgtggtccccatggtgacccagatggccatgacggacaccacccccttcggccagcagcgcgtcttcaaggagaaggtggacacccggacgccgcgcagcatgcccggcacccggcgcgtgatggggatcaccgccgagtggctctggcggaccctgggccgcaacaagaagccccggctgtgcacgcgcgaggagttcaccaagaaggtccgcaccaacgcggccatgggggccgtgttcaccgaggagaaccagtgggacagcgccaaggccgcggtggaggacgaggacttctggaagctcgtcgaccgggagcgcgagctgcacaagctgggcaagtgcgggtcctgcgtgtacaacatgatgggcaagcgggagaagaagctcggcgagttcgggaaggccaagggcagccgcgccatctggtacatgtggctgggggcccggtacctggagttcgaggccctcggcttcctgaacgaggaccactggttctcccgcgagaacagctactccggggtggagggcgagggcctgcacaagctcgggtacatcctgcgggacatcagcaagatccccggcggggcgatgtacgccgacgacacggccggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaccggcaccgtcatggacatcatctcccggaaggaccagcgcgggagcggccaggtggggacctacggcctgaacacgttcaccaacatggaggcgcagctcatccggcagatggagggggagggcgtgctgtccaaggccgacctggagagcccccacctcccggagaagaagatcacccagtggctggagaccaagggcgtcgagcgcctgaagcggatggccatctccggggacgactgcgtggtgaagcccatcgacgaccgcttcgccaacgccctcctggcgctgaacgacatgggcaaggtccggaaggacatcccccagtggcagcccagcaaggggtggcacgactggcagcaggtcccgttctgctcccaccacttccacgagctcatcatgaaggacggccgcaagctggtggtcccctgccggccccaggacgagctgatcgggcgcgcccggatcagccagggcgccggctggtccctccgcgagacggcctgcctggggaaggcgtacgcccagatgtggagcctgatgtacttccaccgccgggacctccgcctggcctccaacgccatctgcagcgccgtgcccgtgcactgggtcccgacctcccggaccacctggagcatccacgcgcaccaccagtggatgacgaccgaggacatgctgaccgtgtggaaccgcgtgtggatcgaggacaacccctggatggaggacaagacccccgtcacgacctgggagaacgtgccctacctcggcaagcgggaggaccagtggtgcgggagcctgatcggcctgacctcccgcgccacctgggcccagaacatcccgacggccatccagcaggtccggagcctcatcgggaacgaggagttcctggactacatgccctccatgaagcgcttccggaaggaggaggagagcgagggcgccatctggtga

SEQ ID NO: 10285 - RNA, 9873 nt, synthetic construct
  misc_feature 1..9873: note = derived and/or modified CDS sequence (opt1) from DENV-3__EU529688__SS-prME
  source 1..9873: mol_type = other RNA
accagcctctgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcagcctcaaggacaccctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgacggtcgagaaggccgcggacgtgacctgggaggaggaggccgagcagaccggcgtgagccacaacctgatgatcaccgtcgacgacgacgggaccatgcgcatcaaggacgacgagacggagaacatcctcaccgtgctgctgaagaccgccctcctgatcgtgtccggcatcttcccgtacagcatccccgccaccctgctcgtctggcacacgtggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctcacgatcatggacctgcaccccgggagcggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagtccgagcacaccggccgggagatcgtggacctgatgtgccacgccacgttcaccatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctccggaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacacgagcgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgtccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccacgaagcgcgacctgggcatgtccaaggagccgggggtggtcagccccacctcctacctggacgtggacctccaccccgccagcgcctggaccctgtacgccgtggcgaccacggtcatcacccccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgacgctgaccgccgccgtcctcctgctgatcacccactacgccatcatcggccccggcctccaggcgaaggccacccgcgaggcccagaagcggacggccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgacgctggccaccggccccatcaccaccctctgggagggctcccccgggaagttctggaacacgaccatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacacgaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccaccgtcgaggagagccggacgatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcacgatgacccaccgccggccgaccatcgagaaggacgtcgacctcggcgcgggcacccgccacgtgaacgccgagcccgagacgcccaacatggacgtgatcggggagcggatcaagcgcatcaaggaggagcacaacagcacctggcactacgacgacgagaacccgtacaagacctgggcctaccacggctcctacgaggtcaaggccaccgggagcgcctccagcatgatcaacggcgtggtcaagctgctgacgaagccctgggacgtggtgcccatggtcacccagatggcgatgaccgacaccacgcccttcgggcagcagcgggtgttcaaggagaaggtggacacccgcaccccgcggagcatgcccggcacccgccgggtcatgggcatcacggccgagtggctctggcgcaccctggggcggaacaagaagccccgcctgtgcacccgggaggagttcaccaagaaggtgcgcacgaacgccgccatgggcgcggtgttcaccgaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtggtgaaggtccagcggcccacccccaccggcacggtgatggacatcatcagccgcaaggaccagcggggctccggccaggtgggcacctacgggctgaacaccttcaccaacatggaggcccagctcatccgccagatggagggcgagggggtcctgagcaaggccgacctggagaacccccacctcccggagaagaagatcacgcagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcacgacctggagcatccacgcccaccaccagtggatgaccaccgaggacatgctgacggtgtggaaccgggtctggatcgaggacaacccctggatggaggacaagacccccgtgaccacctgggagaacgtgccctacctcgggaagcgcgaggaccagtggtgcggcagcctgatcgggctgacgtcccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10286 - RNA, 9873 nt, synthetic construct
  misc_feature 1..9873: note = derived and/or modified CDS sequence (opt1) from DENV-3__EU482613__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggggagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggagcgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacctacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaagatcgtggggctgtacggcaacggggtcgtgacgaagaacggcgggtacgtgtccggcatcgcccagaccaacgccgagccggacggccccacccccgagctggaggaggagatgttcaagaagcggaacctcaccatcatggacctgcaccccgggagcggcaagacgcgcaagtacctgccggccatcgtccgggaggcgatcaagcgccggctccgcaccctgatcctggcccccacccgggtggtggccgccgagatggaggaggccctcaaggggctgcccatccgctaccagaccacggcgaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcctccatcgccgcgcgcgggtacatcagcacccgggtcggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccgcgccggtgcctcaagcccgtgatcctgaccgacggccccgagcgcgtgatcctggccgggcccatgccggtcaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtggagctgatgcgccgcggggacctccccgtctggctggcgcacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtgcccacccacctcgcccaccgcacccggaacgccctggacaacctggtcatgctccacacgtccgagcacggcgggaaggcctaccgccacgcggtggaggagctgcccgagaccatggagaccctgctcctgctgggcctcatgatcctgctgaccgggggcgccatgctgttcctgatcagcggcaaggggatcggcaagacgagcatcgggctgatctgcgtgatcgcctccagcggcatgctctggatggccgagatcccgctgcagtggatcgcctccgcgatcgtcctggagttcttcatgatggtgctcctgatccccgagcccgagaagcagcggacgccccaggacaaccagctggcctacgtggtcatcgggatcctcaccctggccgccatcatcgccgcgaacgagatgggcctgctcgagaccacgaagcgcgacctgggcatgagcaaggagccgggggtggtgtcccccaccagctacctggacgtcgacctccaccccgcctccgcctggaccctgtacgccgtggcgaccacggtgatcacccccatgctgcggcacaccatcgagaacagcaccgccaacgtctccctcgccgccatcgccaaccaggcggtggtgctgatgggcctggacaaggggtggccgatcagcaagatggacctcggcgtccccctgctggccctcgggtgctactcccaggtgaaccccctgacgctgaccgccgccgtgctcctgctgatcacccactacgccatcatcggccccggcctccaggcgaaggccacccgcgaggcccagaagcggacggccgccgggatcatgaagaacccgaccgtcgacggcatcatgaccatcgacctggaccccgtgatctacgacagcaagttcgagaagcagctgggccaggtgatgctcctggtcctgtgcgcggtgcagctcctgctgatgcgcacctcctgggccctctgcgaggccctgacgctggccaccggccccatcaccaccctctgggagggcagccccgggaagttctggaacacgaccatcgcggtgtccatggccaacatcttccggggcagctacctggccggggccggcctggccttctccatcatgaagtccgtcgggaccggcaagcgcggcaccgggtcccagggcgagaccctcggggagaagtggaagaagaagctgaaccagctgagccggaaggagttcgacctctacaagaagtccggcatcacggaggtggaccgcaccgaggcgaaggaggggctgaagcggggcgagatcacccaccacgccgtgtcccgcggcagcgccaagctgcagtggttcgtcgagcggaacatggtgatcccggaggggcgcgtgatcgacctcggctgcgggcggggcgggtggtcctactactgcgccggcctgaagaaggtcaccgaggtgcgcggctacacgaagggcgggcccgggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccggacgatccgcgtcctgaagatggtggagccgtggctcaagaacaaccagttctgcatcaaggtgctgaacccctacatgcccaccgtcatcgagcacctggagcgcctccagcggaagcacggcgggatgctggtgcgcaaccccctgagccggaactccacccacgagatgtactggatcagcaacggcaccgggaacatcgtggcctccgtcaacatggtgagccgcctcctgctgaaccggttcacgatgacccaccgccggccgaccatcgagaaggacgtggacctcggcgcgggcacccgccacgtcaacgccgagcccgagacgcccaacatggacgtgatcggggagcggatcaagcgcatcaaggaggagcacaactccacctggcactacgacgacgagaacccgtacaagacctgggcctaccacggcagctacgaggtgaaggccaccgggtccgccagctccatgatcaacggcgtcgtgaagctgctgacgaagccctgggacgtcgtgcccatggtgacccagatggcgatgaccgacaccacgcccttcgggcagcagcgggtcttcaaggagaaggtggacacccgcaccccgcggagcatgcccggcacccgccgggtgatgggcatcacggccgagtggctctggcgcaccctggggcggaacaagaagccccgcctgtgcacccgggaggagttcaccaagaaggtccgcacgaacgccgccatgggcgcggtgttcaccgaggagaaccagtgggacagcgccaaggccgccgtggaggacgaggacttctggaagctcgtcgaccgcgagcgggagctgcacaagctggggaagtgcggctcctgcgtgtacaacatgatggggaagcgcgagaagaagctcggcgagttcggcaaggccaaggggagccgggcgatctggtacatgtggctgggcgcccgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgcggggtgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaccggcacggtcatggacatcatctcccgcaaggaccagcggggcagcggccaggtgggcacctacgggctgaacaccttcaccaacatggaggcccagctcatccgccagatggagggcgagggggtgctgtccaaggccgacctggagaacccccacctcccggagaagaagatcacgcagtggctggagaccaagggcgtcgagcggctgaagcgcatggcgatcagcggcgacgactgcgtggtgaagcccatcgacgaccggttcgccaacgccctcctggccctgaacgacatggggaaggtccgcaaggacatcccccagtggcagccctccaagggctggcacgactggcagcaggtcccgttctgcagccaccacttccacgagctcatcatgaaggacgggcggaagctggtggtcccctgccgcccccaggacgagctgatcggccgggcccgcatctcccagggggcgggctggagcctccgggagaccgcctgcctgggcaaggcctacgcccagatgtggtccctgatgtacttccaccgccgcgacctccggctggcgagcaacgccatctgctccgccgtgcccgtgcactgggtcccgaccagccgcacgacctggtccatccacgcccaccaccagtggatgaccaccgaggacatgctgacggtgtggaaccgggtgtggatcgaggacaacccctggatggaggacaagacccccgtcaccacctgggagaacgtgccctacctcgggaagcgcgaggaccagtggtgcggcagcctgatcgggctgacgagccgggccacctgggcgcagaacatcccgaccgccatccagcaggtccgctccctcatcggcaacgaggagttcctggactacatgcccagcatgaagcggttccgcaaggaggaggagtccgagggggccatctggtga

SEQ ID NO: 10287 - RNA, 9873 nt, synthetic construct
  misc_feature 1..9873: note = derived and/or modified CDS sequence (opt1) from DENV-3__EU529690__SS-prME
  source 1..9873: mol_type = other RNA
accagcctctgcctcatgatgatcctgcccgccgccctggcgttccacctcacctcccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcaacctcaaggacaccctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggaccagcgccgacctgacggtcgagaaggccgcggacgtgacctgggaggaggaggccgagcagaccggcgtgtcccacaacctgatgatcaccgtcgacgacgacgggaccatgcgcatcaaggacgacgagacggagaacatcctcaccgtgctgctgaagaccgccctcctgatcgtgagcggcatcttcccgtactccatccccgccaccctgctcgtctggcacacgtggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctcacctacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagaccatgcccggcacgttccagaccaccaccggggagatcggcgcgatcgccctggacttcaagcccgggacgtccggcagccccatcatcaaccgcgagggcaaggtggtcgggctgtacggcaacggggtggtgaccaagaacggcgggtacgtcagcggcatcgcccagaccaacgccgagccggacggccccacccccgagctggaggaggagatgttcaagaagcggaacctcacgatcatggacctgcaccccgggtccggcaagacccgcaagtacctgccggccatcgtgcgggaggcgatcaagcgccggctccgcaccctgatcctggcccccacccgggtggtcgccgccgagatggaggaggccctcaaggggctgcccatccgctaccagacgaccgcgaccaagagcgagcacaccggccgggagatcgtggacctgatgtgccacgccacgttcaccatgcgcctcctgtcccccgtgcgggtcccgaactacaacctgatcatcatggacgaggcccacttcaccgaccccgccagcatcgccgcgcgcgggtacatctccacccgggtgggcatgggcgaggccgccgccatcttcatgacggcgacgccgcccgggaccgccgacgccttcccgcagagcaacgcccccatccaggacgaggagcgcgacatccccgagcgctcctggaacagcggcaacgagtggatcaccgacttcgccgggaagacggtgtggttcgtcccctccatcaaggcgggcaacgacatcgccaactgcctccggaagaacgggaagaaggtgatccagctgagccgcaagaccttcgacaccgagtaccagaagaccaagctgaacgactgggacttcgtggtcacgaccgacatctccgagatgggcgccaacttcaaggccgaccgggtgatcgacccgcgccggtgcctcaagcccgtgatcctgaccgacggccccgagcgcgtcatcctggccgggcccatgccggtgaccgcggccagcgccgcccagcggcgcggccgggtggggcgcaacccccagaaggagaacgaccagtacatcttcaccggccagcccctcaacaacgacgaggaccacgcccactggacggaggcgaagatgctgctggacaacatcaacacccccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacaccgaccgcaagtggtgcttcgacgggcagcggaacaaccagatcctggaggagaacatggacgtggagatctggacgaaggagggcgagaagaagaagctccgcccccggtggctggacgcccgcacctacagcgacccgctggccctcaaggagttcaaggacttcgccgcgggccgcaagtccatcgccctggacctggtgaccgagatcgggcgggtccccacccacctcgcccaccgcacgcggaacgccctggacaacctggtgatgctccacaccagcgagcacggcgggaaggcctaccgccacgcggtggaggagctgcccgagaccatggagaccctgctcctgctgggcctcatgatcctgctgaccggcggggccatgctgttcctgatctccgggaaggggatcggcaagaccagcatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagacgaccaagcgcgacctgggcatgtccaaggagccgggggtggtcagccccacctcctacctggacgtggacctccaccccgccagcgcctggaccctgtacgccgtggcgacgaccgtcatcacccccatgctgcggcacaccatcgagaactccacggccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgaccgccgccgtcctcctgctgatcacccactacgccatcatcggccccggcctccaggcgaaggccacgcgcgaggcccagaagcggaccgccgccgggatcatgaagaacccgaccgtggacggcatcatgaccatcgacctggaccccgtgatctacgactccaagttcgagaagcagctggggcaggtcatgctcctggtgctgtgcgcggtgcagctcctgctgatgcgcacgagctgggccctctgcgaggccctgaccctggccaccggccccatcaccacgctctgggagggctcccccgggaagttctggaacaccaccatcgcggtcagcatggccaacatcttccggggctcctacctggccggggccggcctggccttcagcatcatgaagtccgtggggaccggcaagcgcggcaccgggagccagggcgagacgctcggggagaagtggaagaagaagctgaaccagctgtcccggaaggagttcgacctctacaagaagtccggcatcaccgaggtggaccgcaccgaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgacggaggtgcgcggctacaccaagggcgggcccgggcacgaggagcccgtccccatgtccacctacggctggaacatcgtgaagctgatgagcgggaaggacgtgttctacctcccgcccgagaagtgcgacaccctgctgtgcgacatcggcgagtccagcccctcccccacggtcgaggagagccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacccacgagatgtactggatctccaacggcacggggaacatcgtcgccagcgtgaacatggtgtcccgcctcctgctgaaccggttcaccatgacccaccgccggccgaccatcgagaaggacgtcgacctcggcgcgggcacgcgccacgtgaacgccgagcccgagacccccaacatggacgtgatcggggagcggatcaagcgcatcaaggaggagcacaacagcacctggcactacgacgacgagaacccgtacaagacctgggcctaccacggctcctacgaggtcaaggccacggggagcgcctccagcatgatcaacggcgtggtcaagctgctgaccaagccctgggacgtggtgcccatggtcacccagatggcgatgaccgacacgacccccttcgggcagcagcgggtgttcaaggagaaggtggacacccgcaccccgcggtccatgcccggcacgcgccgggtcatgggcatcaccgccgagtggctctggcgcaccctggggcggaacaagaagccccgcctgtgcacccgggaggagttcacgaagaaggtgcgcaccaacgccgccatgggcgcggtgttcaccgaggagaaccagtgggacagcgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacgcggatcaccgaggacgacctgcacaacgaggagaagatcacccagcagatggacccggagcaccgccagctcgccaacgccatcttcaagctgacctaccagaacaaggtggtgaaggtccagcggcccacccccacgggcaccgtgatggacatcatcagccgcaaggaccagcggggctccggccaggtgggcacctacgggctgaacaccttcacgaacatggaggcccagctcatccgccagatggagggcgagggggtcctgagcaaggccgacctggagaacccccacctcccggagaagaagatcacccagtggctggagaccaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacgtcccgcaccacctggagcatccacgcccaccaccagtggatgaccacggaggacatgctgaccgtgtggaaccgggtctggatcgaggacaacccctggatggaggacaagacccccgtgaccacgtgggagaacgtgccctacctcgggaagcgcgaggaccagtggtgcggctccctgatcgggctgaccagccgggccacctgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10288 - RNA, 9873 nt, synthetic construct
  misc_feature 1..9873: note = derived and/or modified CDS sequence (opt1) from DENV-3__EU529691__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacagcggccgcctgatcacggccaaccccgtcgtgaccaagaaggaggagcccgtgaacatcgaggccgagccgcccttcggggagtccaacatcgtcatcggcatcggggacaacgcgctgaagatcaactggtacaagaagggcagctccatcgggaagatgttcgaggccaccgcccggggcgcccgccggatggccatcctgggcgacaccgcgtgggacttcgggagcgtgggcggggtgctcaactccctgggcaagatggtccaccagatcttcgggagcgcctacacggccctgttctccggcgtgagctgggtgatgaagatcggcatcggggtcctcctgacctggatcggcctgaactccaagaacaccagcatgtccttcagctgcatcgccgtggggatcatcaccctctacctgggcgccgtggtccaggcggacatggggtgcgtgatcaactggaagggcaaggagctgaagtgcggctccgggatcttcgtgacgaacgaggtccacacctggaccgagcagtacaagttccaggccgacagccccaagcgcctcgccaccgccatcgccggcgcgtgggagaacggggtgtgcggcatccgctccacgacccggatggagaacctgctgtggaagcagatcgccaacgagctcaactacatcctgtgggagaacaacatcaagctgaccgtggtcgtgggggacatcatcggcgtgctcgagcagggcaagcgcaccctgacgccccagccgatggagctgaagtacagctggaagacctgggggaaggccaagatcgtcaccgccgagacccagaactccagcttcatcatcgacggccccaacacgcccgagtgcccctccgcgagccgggcctggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgcggacatgggctactggatcgagtcccagaagaacgggagctggaagctggagaaggcctccctgatcgaggtgaagacctgcacgtggcccaagtcccacaccctctggtccaacggcgtgctggagagcgacatgatcatccccaagtccctggccgggcccatcagccagcacaaccaccggccgggctaccacacccagaccgccgggccctggcacctcggcaagctggagctggacttcaactactgcgagggcacgaccgtcgtgatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtcaagtccctggtgagcgccggctccgggaaggtggacaacttcacgatgggcgtcctgtgcctcgcgatcctgttcgaggaggtgatgcgggggaagttcggcaagaagcacatgatcgccggggtgttcttcaccttcgtcctgctcctgagcggccagatcacctggcgcgacatggcccacaccctgatcatgatcggctccaacgccagcgaccggatggggatgggcgtgacgtacctcgccctgatcgcgaccttcaagatccagcccttcctggccctcgggttcttcctgcgcaagctgaccagccgggagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctgatctccctcacgtgcagcaacaccatgttcaccctgaccgtcgcctggcgcacggcgaccctgatcctcgccggggtgtccctgctgccggtctgccagagctccagcatgcggaagaccgactggctccccatggccgtggccgccatgggcgtgccgcccctcccgctgttcatcttctccctcaaggacaccctgaagcgccgcagctggcccctgaacgagggggtcatggcggtgggcctcgtgtccatcctggccagctccctgctccggaacgacgtccccatggccggccccctggtggccgggggcctgctcatcgcctgctacgtgatcacggggaccagcgcggacctgaccgtcgagaaggccgccgacatcacctgggaggaggaggccgagcagacgggcgtgtcccacaacctgatgatcaccgtggacgacgacgggaccatgcgcatcaaggacgacgagaccgagaacatcctcaccgtcctgctgaagacggccctcctgatcgtgagcggcgtgttcccgtactccatccccgcgaccctgctcgtctggcacacctggcagaagcagacccagcggagcggcgtgctgtgggacgtgcccagcccgcccgagacgcagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacgtacaacgggaagcgcctggagcccaactgggccagcgtgaagaaggacctgatctcctacggcgggggctggcggctcagcgcgcagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggctcccccatcatcaaccgcgagggcaaggtggtcgggctgtacggcaacggggtggtgaccaagaacggcgggtacgtcagcggcatcgcccagacgaacgcggagccggacggccccacccccgagctggaggaggagatgttcaagaagcggaacctcaccatcatggacctgcaccccgggtccggcaagacccgcaagtacctgccggccatcgtgcgggaggccatcaagcgccggctccgcacgctgatcctggcccccacccgggtggtcgccgcggagatggaggaggccctcaaggggctgcccatccgctaccagaccaccgccaccaagagcgagcacaccggccgggagatcgtggacctgatgtgccacgccaccttcaccatgcgcctcctgtcccccgtgcgggtcccgaactacaacctgatcatcatggacgaggcccacttcacggaccccgcgagcatcgccgcccgcgggtacatctccacccgggtgggcatgggcgaggccgcggccatcttcatgaccgccacgccgcccgggacggccgacgccttcccgcagagcaacgcgcccatccaggacgaggagcgcgacatccccgagcgctcctggaacagcggcaacgagtggatcaccgacttcgccgggaagaccgtgtggttcgtcccctccatcaaggccggcaacgacatcgccaactgcctccggaagaacgggaagaaggtgatccagctgagccgcaagaccttcgacacggagtaccagaagaccaagctgaacgactgggacttcgtggtcaccaccgacatctccgagatgggcgccaacttcaaggcggaccgggtgatcgacccgcgccggtgcctcaagcccgtgatcctgacggacggccccgagcgcgtcatcctggccgggcccatgccggtgaccgccgccagcgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagagccggaagacgttcgtcgagctgatgcgccgcggggacctccccgtgtggctggcccacaaggtcgcctccgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggcgctcaaggagttcaaggacttcgccgccggccgcaagtccatcgccctggacctggtgacggagatcgggcgggtccccagccacctcgcccaccgcacccggaacgcgctggacaacctggtgatgctccacaccagcgagcacggcgggcgcgcctaccggcacgccgtggaggagctgcccgagaccatggagacgctgctcctgctgggcctcatgatcctgctgaccgggggcgccatgctgttcctgatctccggcaaggggatcggcaagaccagcatcgggctgatctgcgtcatcgcctccagcggcatgctctggatggcggagatcccgctgcagtggatcgcctccgccatcgtgctggagttcttcatgatggtgctcctgatccccgagcccgagaagcagcgcacgccccaggacaaccagctggcctacgtcgtgatcgggatcctcacgctggccgcgatcatcgccgccaacgagatgggcctgctcgagaccaccaagcgggacctgggcatgagcaaggagccgggggtggtctcccccaccagctacctggacgtggacctccaccccgcctccgcgtggacgctgtacgccgtggccaccaccgtcatcacccccatgctgcgccacacgatcgagaacagcaccgccaacgtgtccctcgccgcgatcgccaaccaggccgtggtcctgatgggcctggacaaggggtggccgatcagcaagatggacctcggcgtgcccctgctggccctcgggtgctactcccaggtgaaccccctgaccctgaccgccgcggtcctcctgctgatcacgcactacgccatcatcggccccggcctccaggccaaggccacccgggaggcccagaagcgcaccgcggccgggatcatgaagaacccgaccgtggacggcatcatgacgatcgacctggaccccgtgatctacgacagcaagttcgagaagcagctggggcaggtcatgctcctggtgctgtgcgccgtgcagctcctgctgatgcggacctcctgggccctctgcgaggcgctgaccctggccaccggccccatcacgaccctctgggagggcagccccgggaagttctggaacaccaccatcgccgtctccatggccaacatcttccgcggcagctacctggccggggcgggcctggccttctccatcatgaagtccgtggggacgggcaagcggggcaccgggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagacgacccaccacgccgtctcccggggcagcgccaagctgcagtggttcgtggagcgcaacatggtgatcccggaggggcgggtcatcgacctcggctgcgggcgcggcgggtggtcctactactgcgcgggcctgaagaaggtgaccgaggtgcggggctacaccaagggcgggcccgggcacgaggagcccgtccccatgagcacgtacggctggaacatcgtgaagctgatgtccgggaaggacgtgttctacctcccgcccgagaagtgcgacaccctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccacggtgatcgagcacctggagcggctccagcgcaagcacggcgggatgctggtgcggaaccccctgagccgcaactccacccacgagatgtactggatcagcaacggcaccgggaacatcgtcgcctccgtgaacatggtgagccggctcctgctgaaccgcttcaccatgacgcaccggcgcccgaccatcgagaaggacgtcgacctcggcgccggcacccggcacgtgaacgccgagcccgagacccccaacatggacgtgatcggggagcgcatcaagcggatcaaggaggagcacaactccacgtggcactacgacgacgagaacccgtacaagacctgggcctaccacggcagctacgaggtcaaggcgaccgggtccgccagcagcatgatcaacggcgtggtcaagctgctgaccaagccctgggacgtggtgcccatggtcacgcagatggccatgaccgacaccacccccttcgggcagcagcgcgtgttcaaggagaaggtggacacgcggaccccgcgctccatgcccggcacccggcgcgtcatgggcatcaccgccgagtggctctggcggacgctggggcgcaacaagaagccccggctgtgcacccgcgaggagttcaccaagaaggtgcgcaccaacgcggccatgggcgccgtgttcacggaggagaaccagtgggacagcgccaaggccgcggtcgaggacgaggacttctggaagctcgtggaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtcgagggggagggcctgcacaagctcggctacatcctgcgggacatcagcaagatccccgggggcgcgatgtacgccgacgacaccgccgggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaccggcaccgtgatggacatcatctcccggaaggaccagcgcggcagcggccaggtgggcacgtacgggctgaacaccttcaccaacatggaggcgcagctcatccggcagatggagggcgagggggtcctgtccaaggccgacctggagaacccccacctcccggagaagaagatcacccagtggctggagacgaagggcgtggagcgcctgaagcggatggccatcagcggcgacgactgcgtggtcaagcccatcgacgaccgcttcgccaacgccctcctggcgctgaacgacatggggaaggtgcggaaggacatcccccagtggcagccctccaagggctggcacgactggcagcaggtcccgttctgcagccaccacttccacgagctcatcatgaaggacgggcgcaagctggtcgtgccctgccggccccaggacgagctgatcggccgcgcccggatctcccagggggccggctggagcctccgcgagaccgcctgcctgggcaaggcgtacgcccagatgtggtccctgatgtacttccaccgccgggacctccgcctggccagcaacgccatctgctccgccgtgcccgtccactgggtgccgaccagccggaccacgtggagcatccacgcgcaccaccagtggatgaccaccgaggacatgctgaccgtgtggaaccgcgtctggatcgaggacaacccctggatggaggacaagacgcccgtgaccacctgggagaacgtgccctacctcgggaagcgggaggaccagtggtgcggctccctgatcgggctgaccagccgcgccacgtgggcccagaacatcccgaccgccatccagcaggtccggtccctcatcggcaacgaggagttcctggactacatgcccagcatgaagcgcttccggaaggaggaggagtccgagggggccatctggtga

SEQ ID NO: 10289 - RNA, 9873 nt, synthetic construct
  misc_feature 1..9873: note = derived and/or modified CDS sequence (opt1) from DENV-3__EU569689__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagacggccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaaggcctgggggaaggccaagatcgtcaccgccgagacccagaacagctccttcatcatcgacggccccaacacccccgagtgccccagcgcgtcccgggcctggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgcggacatgggctactggatcgagagccagaagaacgggtcctggaagctggagaaggccagcctgatcgaggtgaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgcgatcctgttcgaggaggtgatgcgggggaagttcggcaagaagcacatgatcgccggggtgttcttcacgttcgtcctgctcctgtccggccagatcacctggcgcgacctggcccacaccctcatcatgatcggcagcaacgcctccgaccggatggggatgggcgtgacctacctggccctgatcgcgacgttcaagatccagcccttcctcgccctggggttcttcctgcgcaagctcaccagccgggagaacctgctgctcggcgtgggcctggccatggccaccaccctgcagctccccgaggacatcgagcagatggcgaacgggatcgccctgggcctgatggccctcaagctgatcacgcagttcgagacctaccagctgtggaccgccctcatcagcctgacctgctccaacacgatcttcaccctgaccgtcgcctggcgcaccgcgacgctcatcctggccggggtgagcctgctcccggtctgccagtccagctccatgcggaagaccgactggctgcccatgaccgtggccgccatgggcgtgccgcccctgcccctgttcatcttcagcctgaaggacaccctgaagcgccgctcctggcccctcaacgagggggtcatggccgtgggcctggtgagcatcctggcgtccagcctcctgcggaacgacgtccccatggccggccccctggtggccgggggcctcctgatcgcctgctacgtgatcacggggacctccgccgacctgaccgtcgagaaggcggccgacgtgacctgggaggaggaggccgagcagacgggcgtgagccacaacctcatgatcaccgtcgacgacgacgggaccatgcgcatcaaggacgacgagaccgagaacatcctgaccgtgctgctcaagacggccctgctgatcgtgtccggcatcttcccgtacagcatccccgccaccctcctggtctggcacacctggcagaagcagacccagcggtccggcgtgctgtgggacgtgcccagcccgcccgagacgcagaaggcggagctcgaggagggggtctaccgcatcaagcagcagggcatcttcgggaagacccaggtgggcgtgggggtccagaaggagggcgtgttccacaccatgtggcacgtgacccggggcgccgtcctgacgtacaacgggaagcgcctggagcccaactgggcctccgtgaagaaggacctcatcagctacggcgggggctggcggctgtccgcccagtggcagaagggggaggaggtgcaggtcatcgcggtggagcccggcaagaaccccaagaacttccagaccatgcccggcaccttccagaccacgaccggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagacgaacgccgagccggacggccccacccccgagctcgaggaggagatgttcaagaagcggaacctgaccatcatggacctgcaccccgggagcggcaagacccgcaagtacctcccggcgatcgtgcgggaggccatcaagcgccggctgcgcacgctgatcctcgcccccacccgggtggtcgccgccgagatggaggaggcgctgaaggggctgcccatccgctaccagaccaccgccacgaagtccgagcacaccggccgggagatcgtggacctcatgtgccacgccaccttcaccatgcgcctgctgagccccgtgcgggtcccgaactacaacctcatcatcatggacgaggcccacttcacggaccccgcctccatcgcggcccgcgggtacatcagcacccgggtgggcatgggcgaggccgccgcgatcttcatgaccgccacgccgcccgggacggccgacgccttcccgcagtccaacgcccccatccaggacgaggagcgcgacatccccgagcgcagctggaactccggcaacgagtggatcaccgacttcgcggggaagaccgtgtggttcgtccccagcatcaaggccggcaacgacatcgccaactgcctgcggaagaacgggaagaaggtgatccagctgtcccgcaagaccttcgacacggagtaccagaagaccaagctcaacgactgggacttcgtggtcaccaccgacatcagcgagatgggcgccaacttcaaggccgaccgggtgatcgacccgcgccggtgcctgaagcccgtgatcctgacggacggccccgagcgcgtcatcctcgcggggcccatgccggtgaccgccgcctccgccgcccagcggcgcggccgggtggggcgcaacccccagaaggagaacgaccagtacatcttcaccggccagcccctgaacaacgacgaggaccacgcgcactggaccgaggccaagatgctgctcgacaacatcaacacccccgaggggatcatcccggccctgttcgagcccgagcgggagaagtccgccgcgatcgacggcgagtaccgcctgaagggcgagtcccggaagacgttcgtcgagctcatgcgccgcggggacctgcccgtgtggctggcccacaaggtcgccagcgagggcatcaagtacaccgaccgcaagtggtgcttcgacgggcagcggaacaaccagatcctcgaggagaacatggacgtggagatctggaccaaggagggcgagaagaagaagctgcgcccccggtggctggacgcccgcacctactccgacccgctcgccctgaaggagttcaaggacttcgcggccggccgcaagagcatcgccctggacctcgtgacggagatcgggcgggtccccacccacctggcccaccgcacccggaacgccctggacaacctcgtgatgctgcacacctccgagcacggcgggaaggcgtaccgccacgccgtggaggagctgcccgagacgatggagaccctcctgctgctcggcctgatgatcctgctcaccgggggcgccatgctgttcctgatcagcggcaaggggatcggcaagaccagcatcgggctcatctgcgtcatcgcctccagcggcatgctgtggatggccgagatcccgctgcagtggatcgcgtccgccatcgtgctcgagttcttcatgatggtgctgctgatccccgagcccgagaagcagcggacgccccaggacaaccagctcgcctacgtcgtgatcgggatcctgaccctggccgccatcatcgcggccaacgagatgggcctcctggagaccaccaagcgcgacctgggcatgagcaaggagccgggggtggtctcccccacgagctacctcgacgtggacctgcaccccgcctccgcctggaccctgtacgcggtggccaccaccgtcatcacgcccatgctccggcacaccatcgagaacagcaccgccaacgtgtccctggccgccatcgcgaaccaggccgtggtcctgatgggcctcgacaaggggtggccgatcagcaagatggacctgggcgtgcccctgctcgccctggggtgctactcccaggtgaaccccctgaccctcacggccgccgtcctgctgctcatcacccactacgcgatcatcggccccggcctgcaggccaaggccacccgcgaggcccagaagcggaccgccgcggggatcatgaagaacccgacggtggacggcatcatgaccatcgacctggaccccgtgatctacgacagcaagttcgagaagcagctcgggcaggtcatgctgctggtgctctgcgccgtgcagctgctgctcatgcgcacctcctgggccctgtgcgaggccctgaccctcgcgacgggccccatcaccaccctgtgggagggcagccccgggaagttctggaacaccacgatcgccgtctccatggccaacatcttccggggcagctacctggccggggccggcctcgcgttctccatcatgaagtccgtggggaccggcaagcgcggcaccgggtcccagggcgagaccctgggggagaagtggaagaagaagctgaaccagctcagccggaaggagttcgacctgtacaagaagtccggcatcaccgaggtggaccgcacggaggccaaggaggggctgaagcggggcgagatcacccaccacgccgtctcccgcggcagcgccaagctccagtggttcgtggagcggaacatggtgatcccggaggggcgcgtcatcgacctgggctgcgggcggggcgggtggtcctactactgcgccggcctgaagaaggtgaccgaggtgcgcggctacaccaagggcgggcccgggcacgaggagcccgtccccatgagcacgtacggctggaacatcgtgaagctcatgtccgggaaggacgtgttctacctgccgcccgagaagtgcgacaccctgctgtgcgacatcggcgagagctcccccagccccaccgtcgaggagtcccggaccatccgcgtgctcaagatggtggagccgtggctgaagaacaaccagttctgcatcaaggtcctgaacccctacatgcccacggtgatcgagcacctcgagcgcctgcagcggaagcacggcgggatgctggtgcgcaaccccctcagccggaactccacccacgagatgtactggatcagcaacggcaccgggaacatcgtcgcgtccgtgaacatggtgagccgcctgctgctcaaccggttcaccatgacgcaccgccggccgaccatcgagaaggacgtcgacctgggcgccggcacccgccacgtgaacgccgagcccgagacccccaacatggacgtgatcggggagcggatcaagcgcatcaaggaggagcacaactccacgtggcactacgacgacgagaacccgtacaagacctgggcctaccacggcagctacgaggtcaaggccaccgggtccgcgagctccatgatcaacggcgtggtcaagctgctcaccaagccctgggacgtggtgcccatggtcacgcagatggccatgaccgacaccacccccttcgggcagcagcgggtgttcaaggagaaggtggacacgcgcaccccgcggagcatgcccggcacccgccgggtcatgggcatcaccgccgagtggctgtggcgcacgctggggcggaacaagaagccccgcctctgcacccgggaggagttcaccaagaaggtgcgcaccaacgccgcgatgggcgccgtgttcacggaggagaaccagtgggacagcgccaaggccgccgtcgaggacgaggacttctggaagctggtggaccgcgagcgggagctgcacaagctcgggaagtgcggctcctgcgtgtacaacatgatggggaagcgcgagaagaagctgggcgagttcggcaaggcgaaggggagccgggccatctggtacatgtggctgggcgcccgctacctcgagttcgaggccctggggttcctgaacgaggaccactggttctcccgggagaacagctactccggcgtcgagggggagggcctccacaagctgggctacatcctgcgcgacatcagcaagatccccgggggcgccatgtacgcggacgacaccgccgggtgggacacccggatcaccgaggacgacctccacaacgaggagaagatcacgcagcagatggacccggagcaccgccagctggccaacgccatcttcaagctgacctaccagaacaaggtggtgaaggtccagcggcccacccccaccggcaccgtgatggacatcatctcccgcaaggaccagcggggcagcggccaggtgggcacgtacgggctcaacaccttcaccaacatggaggcccagctgatccgccagatggagggcgagggggtcctgtccaaggcggacctcgagaacccccacctcccggagaagaagatcacccagtggctggagacgaagggcgtggagcggctcaagcgcatggccatcagcggcgacgactgcgtggtcaagcccatcgacgaccggttcgccaacgccctgctggccctcaacgacatggggaaggtgcgcaaggacatcccccagtggcagccctccaagggctggcacgactggcagcaggtcccgttctgcagccaccacttccacgagctgatcatgaaggacgggcggaagctggtcgtgccctgccgcccccaggacgagctcatcggccgggcgcgcatctcccagggggccggctggagcctgcgggagaccgcctgcctgggcaaggcctacgcgcagatgtggtccctcatgtacttccaccgccgcgacctgcggctggccagcaacgccatctgctccgccgtgcccgtccactgggtgccgaccagccgcaccacgtggtccatccacgcccaccaccagtggatgaccaccgaggacatgctcaccgtgtggaaccgggtctggatcgaggacaacccctggatggaggacaagacgcccgtgaccacctgggagaacgtgccctacctggggaagcgcgaggaccagtggtgcggcagcctgatcgggctcaccagccgggcgacgtgggcccagaacatcccgaccgccatccagcaggtccgctccctgatcggcaacgaggagttcctggactacatgcccagcatgaagcggttccgcaaggaggaggagtccgagggggccatctggtga

SEQ ID NO: 10290 - RNA, 9873 nt, synthetic construct
  misc_feature 1..9873: note = derived and/or modified CDS sequence (opt1) from DENV-3__EU482614__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacatggggtgcgtgatcaactggaagggcaaggagctgaagtgcggcagcgggatcttcgtgacgaacgaggtccacacctggaccgagcagtacaagttccaggcggactcccccaagcgcctcgccaccgccatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagccgatggagctgaagtactcctggaagacctgggggaaggccaagatcgtcaccgccgagacccagaacagctccttcatcatcgacggccccaacacgcccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtcgtgatcaccgagaactgcgggacccgcggccccagcctccggacgaccaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtgtccgccggcagcggggaggtggacaacttcacgatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacaccctgatcatgatcggcagcaacgcctccgaccggatggggatgggcgtgacgtacctcgccctgatcgccaccttcaagatccagcccttcctggcgctcgggttcttcctgcgcaagctgaccagccgggagaacctcctgctgggcgtgggcctcgccatggccaccacgctgcagctgcccgaggacatcgagcagatggccaacgggatcgcgctcggcctgatggccctgaagctcatcacccagttcgagacctaccagctgtggaccgccctgatcagcctcacgtgctccaacaccatcttcaccctgaccgtcgcctggcgcacggccaccctgatcctcgcgggggtgagcctgctgccggtctgccagtccagctccatgcggaagaccgactggctccccatgaccgtggccgccatgggcgtgccgcccctcccgctgttcatcttcagcctcaaggacacgctgaagcgccgctcctggcccctgaacgagggggtcatggccgtgggcctcgtgagcatcctggcctccagcctgctccggaacgacgtccccatggcgggccccctggtggccgggggcctgctcatcgcctgctacgtgatcaccgggacctccgccgacctgaccgtcgagaaggccgcggacgtgacgtgggaggaggaggccgagcagaccggcgtgagccacaacctgatgatcaccgtcgacgacgacgggaccatgcgcatcaaggacgacgagaccgagaacatcctcacggtgctgctgaagaccgccctcctgatcgtgtccggcatcttcccgtacagcatccccgccaccctgctcgtctggcacacctggcagaagcagacgcagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacgcggggcgcggtcctcacccacaacgggaagcgcctggagcccaactgggcctccgtgaagaaggacctgatcagctacggcgggggctggcggctctccgcccagtggcagaagggggaggaggtgcaggtcatcgccgtggagcccggcaagaaccccaagaacttccagaccatgcccggcaccttccagacgaccaccggggagatcggcgcgatcgccctggacttcaagcccgggaccagcggcagccccatcatcaaccgcgagggcaaggtggtcgggctgtacggcaacggggtggtgacgaagaacggcgggtacgtctccggcatcgcccagaccaacgccgagccggacggccccacccccgagctggaggaggagatgttcaagaagcggaacctcaccatcatggacctgcaccccgggagcggcaagacgcgcaagtacctgccggccatcgtgcgggaggcgatcaagcgccggctccgcaccctgatcctggcccccacccgggtggtcgccgccgagatggaggaggccctcaaggggctgcccatccgctaccagaccacggcgaccaagtccgagcacaccggccgggagatcgtggacctgatgtgccacgccaccttcacgatgcgcctcctgagccccgtgcgggtcccgaactacaacctgatcatcatggacgaggcccacttcaccgaccccgcctccatcgccgcgcgcgggtacatcagcacccgggtgggcatgggcgaggccgccgccatcttcatgaccgcgacgccgcccgggaccgccgacgccttcccgcagtccaacgcccccatccaggacgaggagcgcgacatccccgagcgcagctggaactccggcaacgagtggatcaccgacttcgccgggaagaccgtgtggttcgtccccagcatcaaggcgggcaacgacatcgccaactgcctccggaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccgcgccggtgcctcaagcccgtgatcctgaccgacggccccgagcgcgtcatcctggccgggcccatgccggtgaccgcggcctccgccgcccagcggcgcggccgggtggggcgcaacccccagaaggagaacgaccagtacatcttcaccggccagcccctcaacaacgacgaggaccacgcccactggaccgaggcgaagatgctgctggacaacatcaacacgcccgaggggatcatcccggccctcttcgagcccgagcgggagaagtccgccgccatcgacggcgagtaccgcctgaagggcgagtcccggaagaccttcgtcgagctgatgcgccgcggggacctccccgtgtggctggcgcacaaggtcgccagcgagggcatcaagtacaccgaccgcaagtggtgcttcgacgggcagcggaacaaccagatcctggaggagaacatggacgtggagatctggaccaaggagggcgagaagaagaagctccgcccccggtggctggacgcccgcacgtactccgacccgctggccctcaaggagttcaaggacttcgccgcgggccgcaagagcatcgccctggacctggtgaccgagatcgggcgggtcccctcccacctcgcccaccgcacccggaacgccctggacaacctggtgatgctccacaccagcgagcacggcgggaaggcctaccgccacgcggtggaggagctgcccgagacgatggagaccctgctcctgctgggcctcatgatcctgctgaccgggggcgccatgctgttcctgatcagcggcaaggggatcggcaagacctccatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcaccctggccgccatcatcgccgcgaacgagatgggcctgctcgagaccaccaagcgcgacctgggcatgtccaaggagccgggggtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgacggccgccgtcctcctgctgatcacccactacgccatcatcggccccggcctccaggcgaaggccacccgcgaggcccagaagcggaccgccgccgggatcatgaagaacccgacggtggacggcatcatgaccatcgacctggaccccgtgatctacgactccaagttcgagaagcagctggggcaggtcatgctcctggtgctgtgcgcggtgcagctcctgctgatgcgcaccagctgggccctctgcgaggccctgaccctggccacgggccccatcaccaccctctgggagggctcccccgggaagttctggaacaccacgatcgcggtcagcatggccaacatcttccggggctcctacctggccggggccggcctggccttcagcatcatgaagtccgtggggaccggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagatcacccaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcgggatgctggtgcgcaaccccctgtcccggaacagcacccacgagatgtactggatctccaacggcaccgggaacatcgtcgccagcgtgaacatggtgtcccgcctcctgctgaaccggttcaccatgacgcaccgccggccgaccatcgagaaggacgtcgacctcggcgcgggcacccgccacgtgaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcctccagcatgatcaacggcgtggtcaagctgctgaccaagccctgggacgtggtgcccatggtcacgcagatggcgatgaccgacaccacccccttcgggcagcagcgggtgttcaaggagaaggtggacacgcgcaccccgcggagcatgcccggcacccgccgggtcatgggcatcaccgccgagtggctctggcgcacgctggggcggaacaagaagccccgcctgtgcacccgggaggagttcaccaagaaggtgcgcaccaacgccgccatgggcgcggtgttcacggaggagaaccagtgggactccgccaaggccgccgtcgaggacgaggacttctggaagctcgtggaccgcgagcgggagctgcacaagctggggaagtgcggcagctgcgtgtacaacatgatggggaagcgcgagaagaagctcggcgagttcggcaaggccaaggggtcccgggcgatctggtacatgtggctgggcgcccgctacctggagttcgaggccctcgggttcctgaacgaggaccactggttcagccgggagaactcctacagcggcgtcgagggggagggcctgcacaagctcggctacatcctgcgcgacatctccaagatccccgggggcgccatgtacgccgacgacaccgcggggtgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccggcaccgtgatggacatcatcagccgcaaggaccagcggggctccggccaggtgggcacgtacgggctgaacaccttcaccaacatggaggcccagctcatccgccagatggagggcgagggggtcctgagcaaggccgacctggagaacccccacctcccggagaagaagatcacccagtggctggagacgaagggcgtggagcggctgaagcgcatggcgatctccggcgacgactgcgtggtcaagcccatcgacgaccggttcgccaacgccctcctggccctgaacgacatggggaaggtgcgcaaggacatcccccagtggcagcccagcaagggctggcacgactggcagcaggtcccgttctgctcccaccacttccacgagctcatcatgaaggacgggcggaagctggtcgtgccctgccgcccccaggacgagctgatcggccgggcccgcatcagccagggggcgggctggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcgggaagcgcgaggaccagtggtgcggcagcctgatcgggctgacctcccgggccacgtgggcgcagaacatcccgaccgccatccagcaggtccgcagcctcatcggcaacgaggagttcctggactacatgccctccatgaagcggttccgcaaggaggaggagagcgagggggccatctggtga

SEQ ID NO: 10291 - RNA, 9873 nt, synthetic construct
  misc_feature 1..9873: note = derived and/or modified CDS sequence (opt1) from DENV-3__EU569690__SS-prME
  source 1..9873: mol_type = other RNA
accagcctctgcctcatgatgatcctgcccgccgccctggcgttccacctcacctcccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgggacaagcggtccgtggccctcgcgccccacgtgggcatggggctggacacccggacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggtcccgcaaggagctcctggtgaccttcaagaacgcccacgccaagaagcaggaggtcgtggtgctggggagccaggagggcgcgatgcacaccgccctcacgggggccaccgagatccagaactccggcgggaccagcatcttcgccggccacctgaagtgccggctgaagatggacaagctcgagctgaagggcatgtcctacgccatgtgcaccaacacgttcgtcctgaagaaggaggtgagcgagacccagcacgggaccatcctcatcaaggtggagtacaagggcgaggacgtcccgtgcaagatccccttcagcaccgaggacgagcaggggaaggcgcacaacggccgcctgatcacggccaaccccgtggtgaccaagaaggaggagcccgtcaacatcgaggccgagccgcccttcggcgagtccaacatcgtgatcgggatcggcgacaacgccctgaagatcaactggtacaagaaggggagctccatcggcaagatgttcgaggcgaccgcccgcggggcccgccggatggccatcctgggcgacaccgcctgggacttcggcagcgtcgggggcgtcctcaactccctggggaagatggtgcaccagatcttcggcagcgcgtacacggccctgttctccggggtgagctgggtcatgaagatcggcatcggcgtgctcctgacctggatcgggctgaactccaagaacaccagcatgtccttcagctgcatcgccatcggcatcatcaccctctacctgggggccgtggtccaggccgacatgggctgcgtgatcaactggaaggggaaggagctgaagtgcggctccggcatcttcgtgacgaacgaggtccacacctggaccgagcagtacaagttccaggcggacagccccaagcgcctcgccaccgccatcgccggggcctgggagaacggcgtgtgcgggatccgctccacgacccggatggagaacctgctgtggaagcagatcgcgaacgagctcaactacatcctgtgggagaacaacatcaagctgaccgtggtcgtgggcgacatcatcggggtgctcgagcagggcaagcgcaccctgatcccccagccgatggagctgaagtacagctggaagacgtggggcaaggccaagatcgtcaccgccgagacccagaactccagcttcatcatcgacgggcccaacacccccgagtgcccctccgccagccgggcgtggaacgtgtgggaggtggaggactacggcttcggggtcttcacgaccaacatctggctcaagctgcgcgaggtgtacacccagctgtgcgaccaccggctcatgagcgccgccgtgaaggacgagcgcgccgtccacgccgacatgggctactggatcgagtcccagaagaacggcagctggaagctggagaaggcgtccctgatcgaggtgaagacctgcacctggcccaagtcccacacgctctggtccaacggggtgctggagagcgacatgatcatccccaagtccctggccggccccatcagccagcacaactaccggccggggtaccacacccagaccgccggcccctggcacctcgggaagctggagctggacttcaactactgcgagggcaccacggtcgtgatcaccgagaactgcggcacccgcgggccctccctccggaccacgaccgtgagcggcaagctgatccacgagtggtgctgccgctcctgcaccctgcccccgctccggtacatgggggaggacggctgctggtacgggatggagatccgccccatcagcgagaaggaggagaacatggtcaagtccctggtgagcgccggctccggcgaggtggacaacttcaccatgggggtcctgtgcctcgccatcctgttcgaggaggtgatgcggggcaagttcgggaagaagcacatgatcgcgggcgtgttcttcacgttcgtcctgctcctgagcgggcagatcacctggcgcgacatggcccacaccctgatcatgatcggctccaacgccagcgaccggatgggcatgggggtgacctacctcgccctgatcgccacgttcaagatccagcccttcctggcgctcggcttcttcctgcgcaagctgaccagccgggagaacctcctgctgggggtgggcctcgccatggccaccaccctgcagctgcccgaggacatcgagcagatggccaacggcatcgcgctcgggctgatggccctgaagctcatcacgcagttcgagacctaccagctgtggaccgccctgatctccctgacctgcagcaacacgatcttcaccctgaccgtcgcctggcgcaccgccacgctgatcctcgcgggcgtgtccctgctgccggtctgccagagctccagcatgcggaagaccgactggctccccatgaccgtggccgccatgggggtgccgcccctcccgctgttcatcttctccctcaaggacaccctgaagcgccgcagctggcccctgaacgagggcgtcatggccgtggggctcgtgtccatcctggccagctccctgctccggaacgacgtccccatggcgggccccctggtggccggcgggctgctcatcgcctgctacgtgatcacgggcaccagcgccgacctgaccgtcgagaaggccgcggacgtgacctgggaggaggaggccgagcagacgggggtgtcccacaacctgatgatcaccgtcgacgacgacggcaccatgcgcatcaaggacgacgagaccgagaacatcctcaccgtgctgctgaagacggccctcctgatcgtgagcgggatcttcccgtactccatccccgccaccctgctcgtctggcacacctggcagaagcagacccagcggagcggcgtgctgtgggacgtgcccagcccgcccgagacgcagaaggccgagctggaggagggcgtctaccgcatcaagcagcaggggatcttcggcaagacccaggtgggggtgggcgtccagaaggagggggtgttccacaccatgtggcacgtgacccggggcgcggtcctcacgtacaacggcaagcgcctggagcccaactgggccagcgtgaagaaggacctgatctcctacgggggcgggtggcggctcagcgcccagtggcagaagggcgaggaggtgcaggtcatcgccgtggagcccgggaagaaccccaagaacttccagaccatgcccggcaccttccagaccacgaccggcgagatcggggcgatcgccctggacttcaagcccggcaccagcgggtcccccatcatcaaccgcgagggcaaggtggtcggcctgtacgggaacggcgtggtgaccaagaacgggggctacgtcagcgggatcgcccagacgaacgccgagccggacggccccacccccgagctggaggaggagatgttcaagaagcggaacctcaccatcatggacctgcaccccggctccgggaagacccgcaagtacctgccggccatcgtgcgggaggcgatcaagcgccggctccgcacgctgatcctggcccccacccgggtggtcgccgccgagatggaggaggccctcaagggcctgcccatccgctaccagaccaccgcgaccaagagcgagcacacggggcgggagatcgtggacctgatgtgccacgccaccttcaccatgcgcctcctgtcccccgtgcgggtcccgaactacaacctgatcatcatggacgaggcccacttcacggaccccgccagcatcgccgcgcgcggctacatctccacccgggtggggatgggcgaggccgccgccatcttcatgaccgcgacgccgcccggcacggccgacgccttcccgcagagcaacgcccccatccaggacgaggagcgcgacatccccgagcgctcctggaacagcgggaacgagtggatcaccgacttcgccggcaagaccgtgtggttcgtcccctccatcaaggcggggaacgacatcgccaactgcctccggaagaacggcaagaaggtgatccagctgagccgcaagaccttcgacacggagtaccagaagaccaagctgaacgactgggacttcgtggtcaccaccgacatctccgagatgggggccaacttcaaggccgaccgggtgatcgacccgcgccggtgcctcaagcccgtgatcctgacggacggccccgagcgcgtcatcctggccggccccatgccggtgaccgcggccagcgccgcccagcggcgcgggcgggtgggccgcaacccccagaaggagaacgaccagtacatcttcaccgggcagcccctcaacaacgacgaggaccacgcccactggaccgaggcgaagatgctgctggacaacatcaacacccccgagggcatcatcccggccctcttcgagcccgagcgggagaagtccgccgccatcgacggggagtaccgcctgaagggcgagagccggaagacgttcgtcgagctgatgcgccggggcgacctccccgtgtggctggcgcacaaggtcgcctccgaggggatcaagtacaccgaccgcaagtggtgcttcgacggccagcggaacaaccagatcctggaggagaacatggacgtggagatctggaccaaggagggggagaagaagaagctccgcccccggtggctggacgcccgcacctacagcgacccgctggccctcaaggagttcaaggacttcgccgcgggccgcaagtccatcgccctggacctggtgacggagatcggccgggtccccacccacctcgcccaccgcacccggaacgccctggacaacctggtgatgctccacaccagcgagcacgggggcaaggcctaccgccacgcggtggaggagctgcccgagacgatggagaccctgctcctgctggggctcatgatcctgctgaccggcggggccatgctgttcctgatcagcggcaagggcatcgggaagacctccatcggcctgatctgcgtcatcgccagctccgggatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcggcatcctcaccctggccgccatcatcgccgcgaacgagatggggctgctcgagaccaccaagcgcgacctgggcatgtccaaggagccgggcgtggtcagccccacgtcctacctggacgtggacctccaccccgccagcgcctggaccctgtacgccgtggcgaccaccgtcatcacgcccatgctgcggcacaccatcgagaactccaccgccaacgtgagcctcgccgccatcgccaaccaggcggtggtcctgatggggctggacaagggctggccgatctccaagatggacctcggggtgcccctgctggccctcggctgctacagccaggtgaaccccctgaccctgacggccgccgtcctcctgctgatcacccactacgccatcatcgggcccggcctccaggcgaaggccacccgcgaggcccagaagcggaccgccgccggcatcatgaagaacccgacggtggacgggatcatgaccatcgacctggaccccgtgatctacgactccaagttcgagaagcagctgggccaggtcatgctcctggtgctgtgcgcggtgcagctcctgctgatgcgcaccagctgggccctctgcgaggccctgaccctggccacggggcccatcaccaccctctgggagggctcccccggcaagttctggaacaccacgatcgcggtcagcatggccaacatcttccgggggtcctacctggccggcgccgggctggccttcagcatcatgaagtccgtgggcaccgggaagcgcggcaccggcagccagggggagaccctcggcgagaagtggaagaagaagctgaaccagctgagccggaaggagttcgacctctacaagaagtccgggatcaccgaggtggaccgcacggaggcgaaggagggcctgaagcgcggggagatcacccaccacgccgtcagccgcggctccgccaagctgcagtggttcgtggagcggaacatggtgatcccggagggccgcgtcatcgacctcgggtgcggccgcgggggctggagctactactgcgccgggctgaagaaggtgaccgaggtgcgcggctacaccaagggcgggcccggccacgaggagcccgtccccatgtccacgtacgggtggaacatcgtgaagctgatgagcggcaaggacgtgttctacctcccgcccgagaagtgcgacaccctgctgtgcgacatcggggagtccagcccctcccccaccgtcgaggagagccggaccatccgcgtgctgaagatggtggagccgtggctcaagaacaaccagttctgcatcaaggtcctgaacccctacatgcccacggtgatcgagcacctggagcgcctccagcggaagcacggcggcatgctggtgcgcaaccccctgtcccggaacagcacccacgagatgtactggatctccaacgggaccggcaacatcgtcgccagcgtgaacatggtgtcccgcctcctgctgaaccggttcaccatgacgcaccgccggccgaccatcgagaaggacgtcgacctcggggcgggcacccgccacgtgaacgccgagcccgagacccccaacatggacgtgatcggcgagcggatcaagcgcatcaaggaggagcacaacagcacgtggcactacgacgacgagaacccgtacaagacctgggcctaccacgggtcctacgaggtcaaggccaccggcagcgcctccagcatgatcaacggggtggtcaagctgctgaccaagccctgggacgtggtgcccatggtcacgcagatggcgatgaccgacaccacccccttcggccagcagcgggtgttcaaggagaaggtggacacgcgcaccccgcggagcatgcccgggacccgccgggtcatgggcatcaccgccgagtggctctggcgcacgctgggccggaacaagaagccccgcctgtgcacccgggaggagttcaccaagaaggtgcgcaccaacgccgccatgggggcggtgttcacggaggagaaccagtgggactccgccaaggccgccgtcgaggacgaggacttctggaagctcgtggaccgcgagcgggagctgcacaagctgggcaagtgcgggagctgcgtgtacaacatgatgggcaagcgcgagaagaagctcggggagttcggcaaggccaagggctcccgggcgatctggtacatgtggctgggggcccgctacctggagttcgaggccctcggcttcctgaacgaggaccactggttcagccgggagaactcctacagcggggtcgagggcgaggggctgcacaagctcggctacatcctgcgcgacatctccaagatccccggcggggccatgtacgccgacgacaccgcgggctgggacacccggatcaccgaggacgacctgcacaacgaggagaagatcacgcagcagatggacccggagcaccgccagctcgccaacgccatcttcaagctgacctaccagaacaaggtggtgaaggtccagcggcccacccccaccgggaccgtgatggacatcatcagccgcaaggaccagcggggctccggccaggtggggacgtacggcctgaacaccttcaccaacatggaggcccagctcatccgccagatggagggggagggcgtcctgagcaaggccgacctggagaacccccacctcccggagaagaagatcacccagtggctggagacgaagggggtggagcggctgaagcgcatggcgatctccggcgacgactgcgtggtcaagcccatcgacgaccggttcgccaacgccctcctggccctgaacgacatgggcaaggtgcgcaaggacatcccccagtggcagcccagcaaggggtggcacgactggcagcaggtcccgttctgctcccaccacttccacgagctcatcatgaaggacggccggaagctggtcgtgccctgccgcccccaggacgagctgatcgggcgggcccgcatcagccagggcgcggggtggtccctccgggagaccgcctgcctgggcaaggcctacgcccagatgtggagcctgatgtacttccaccgccgcgacctccggctggcgtccaacgccatctgcagcgccgtgcccgtccactgggtgccgacctcccgcaccacgtggagcatccacgcccaccaccagtggatgaccaccgaggacatgctgaccgtgtggaaccgggtctggatcgaggacaacccctggatggaggacaagacgcccgtgaccacctgggagaacgtgccctacctcggcaagcgcgaggaccagtggtgcgggagcctgatcggcctgacctcccgggccacgtgggcgcagaacatcccgaccgccatccagcaggtccgcagcctcatcgggaacgaggagttcctggactacatgccctccatgaagcggttccgcaaggaggaggagagcgagggcgccatctggtga

SEQ ID NO: 10292 - RNA, 9873 nt, synthetic construct
  misc_feature 1..9873: note = derived and/or modified CDS sequence (opt1) from DENV-3__EU569691__SS-prME
  source 1..9873: mol_type = other RNA
accagcctctgcctcatgatgatcctgcccgccgccctggcgttccacctcacctcccgggacggggagccccggatgatcgtggggaagaacgagcggggcaagagcctgctgttcaagaccgcctccgggaccaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacgtggatgagcgccgagggcgcctggcgccaggtggagaaggtcgagacctgggccctgcgccacccggggttcaccatcctcgcgctgttcctggcccactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggcgaccctccggaagctgtgcatcgagggcaagatcaccaacatcaccacggacagccgctgccccacccagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacacggtgatcatcaccgtccacaccggggaccagcaccaggtgggcaacgagacccagggggtcacggccgagatcacgccccaggccagcaccaccgaggcgatcctgcccgagtacggcaccctggggctcgagtgctccccgcgcacgggcctggacttcaacgagatgatcctgctcaccatgaagaacaaggcctggatggtgcaccggcagtggttcttcgacctgcccctgccctggaccagcggcgccaccacggagacccccacctggaaccgcaaggagctcctggtgaccttcaagaacgcccacgccaagaagcaggaggtcgtggtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtcctgaagaaggaggtgtccgagacccagcacgggaccatcctcatcaaggtggagtacaagggcgaggacgtcccgtgcaagatccccttcagcacggaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtcctcaacagcctgggcaagatggtgcaccagatcttcgggtccgcgtacaccgccctgttcagcggcgtgtcctgggtcatgaagatcggcatcggggtgctcctgacctggatcggcctgaacagcaagaacacctccatgagcttctcctgcatcgccatcgggatcatcacgctctacctgggcgccgtggtccaggccgacatggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacgtgcacctggccgaagtcccacaccctctggagcaacggcgtgctggagtccgacatgatcatccccaagagcctggccgggcccatctcccagcacaactaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcggggaggtggacaacttcaccatgggcgtcctgtgcctcgccatcctgttcgaggaggtgatgcgggggaagttcggcaagaagcacatgatcgcgggggtgttcttcaccttcgtcctgctcctgtccggccagatcacctggcgcgacatggcccacacgctgatcatgatcggcagcaacgcctccgaccggatggggatgggcgtgacctacctcgccctgatcgccaccttcaagatccagcccttcctggcgctcgggttcttcctgcgcaagctgaccagccgggagaacctcctgctgggcgtgggcctcgccatggccacgaccctgcagctgcccgaggacatcgagcagatggccaacgggatcgcgctcggcctgatggccctgaagctcatcacccagttcgagacctaccagctgtggacggccctgatcagcctgacctgctccaacaccatcttcaccctgacggtcgcctggcgcaccgccaccctgatcctcgcgggggtgagcctgctgccggtctgccagtccagctccatgcggaagaccgactggctccccatgacggtggccgccatgggcgtgccgcccctcccgctgttcatcttcaccctcaaggacaccctgaagcgccgcagctggcccctgaacgagggggtcatggccgtgggcctcgtgtccatcctggccagctccctgctccggaacgacgtccccatggcgggccccctggtggccgggggcctgctcatcgcctgctacgtgatcaccgggacgagcgccgacctgaccgtcgagaaggccgcggacgtgacctgggaggaggaggccgagcagaccggcgtgtcccacaacctgatgatcaccgtcgacgacgacgggacgatgcgcatcaaggacgacgagaccgagaacatcctcaccgtgctgctgaagaccgccctcctgatcgtgagcggcatcttcccgtactccatccccgccacgctgctcgtctggcacacctggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgcggtcctcacccacaacgggaagcgcctggagcccaactgggccagcgtgaagaaggacctgatctcctacggcgggggctggcggctcagcgcccagtggcagaagggggaggaggtgcaggtcatcgccgtggagcccggcaagaaccccaagaacttccagacgatgcccggcaccttccagaccaccacgggggagatcggcgcgatcgccctggacttcaagcccgggacctccggcagccccatcatcaaccgcgagggcaaggtggtcgggctgtacggcaacggggtggtgaccaagaacggcgggtacgtcagcggcatcgcccagaccaacgccgagccggacggccccacgcccgagctggaggaggagatgttcaagaagcggaacctcaccatcatggacctgcaccccgggtccggcaagacccgcaagtacctgccggccatcgtgcgggaggcgatcaagcgccggctccgcaccctgatcctggcccccacgcgggtggtcgccgccgagatggaggaggccctcaaggggctgcccatccgctaccagaccaccgcgaccaagagcgagcacacgggccgggagatcgtggacctgatgtgccacgccaccttcaccatgcgcctcctgtcccccgtgcgggtcccgaactacaacctgatcatcatggacgaggcccacttcaccgaccccgccagcatcgccgcgcgcgggtacatctccacgcgggtgggcatgggcgaggccgccgccatcttcatgaccgcgacgccgcccgggaccgccgacgccttcccgcagagcaacgcccccatccaggacgaggagcgcgacatccccgagcgctcctggaacagcggcaacgagtggatcacggacttcgccgggaagaccgtgtggttcgtcccctccatcaaggcgggcaacgacatcgccaactgcctccggaagaacgggaagaaggtgatccagctgagccgcaagaccttcgacaccgagtaccagaagacgaagctgaacgactgggacttcgtggtcaccaccgacatctccgagatgggcgccaacttcaaggccgaccgggtgatcgacccgcgccggtgcctcaagcccgtgatcctgaccgacggccccgagcgcgtcatcctggccgggcccatgccggtgaccgcggccagcgccgcccagcggcgcggccgggtggggcgcaacccccagaaggagaacgaccagtacatcttcacgggccagcccctcaacaacgacgaggaccacgcccactggaccgaggcgaagatgctgctggacaacatcaacacccccgaggggatcatcccggccctcttcgagcccgagcgggagaagtccgccgccatcgacggcgagtaccgcctgaagggcgagagccggaagaccttcgtcgagctgatgcgccgcggggacctccccgtgtggctggcgcacaaggtcgcctccgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctacagcgacccgctggccctcaaggagttcaaggacttcgccgcgggccgcaagtccatcgccctggacctggtgaccgagatcgggcgggtccccacgcacctcgcccaccgcacccggaacgccctggacaacctggtgatgctccacaccagcgagcacggcgggaaggcctaccgccacgcggtggaggagctgcccgagaccatggagacgctgctcctgctgggcctcatgatcctgctgaccgggggcgccatgctgttcctgatctccggcaaggggatcggcaagaccagcatcgggctgatctgcgtcatcgccagctccggcatgctctggatggccgagatcccgctgcagtggatcgccagcgcgatcgtgctggagttcttcatgatggtgctcctgatccccgagcccgagaagcagcggacgccccaggacaaccagctggcctacgtcgtgatcgggatcctcacgctggccgccatcatcgccgcgaacgagatgggcctgctcgagaccaccaagcgcgacctgggcatgtccaaggagccgggggtggtcagccccacctcctacctggacgtggacctccaccccgccagcgcctggacgctgtacgccgtggcgaccaccgtcatcacccccatgctgcggcacacgatcgagaactccaccgccaacgtgagcctcgccgccatcgccaaccaggcggtggtcctgatgggcctggacaaggggtggccgatctccaagatggacctcggcgtgcccctgctggccctcgggtgctacagccaggtgaaccccctgaccctgaccgccgccgtcctcctgctgatcacgcactacgccatcatcggccccggcctccaggcgaaggccacccgcgaggcccagaagcggaccgccgccgggatcatgaagaacccgaccgtggacggcatcatgacgatcgacctggaccccgtgatctacgactccaagttcgagaagcagctggggcaggtcatgctcctggtgctgtgcgcggtgcagctcctgctgatgcgcaccagctgggccctctgcgaggccctgaccctggccaccggccccatcacgaccctctgggagggctcccccgggaagttctggaacaccaccatcgcggtcagcatggccaacatcttccggggctcctacctggccggggccggcctggccttcagcatcatgaagtccgtggggaccggcaagcgcggcacggggagccagggcgagaccctcggggagaagtggaagaagaagctgaaccagctgtcccggaaggagttcgacctctacaagaagtccggcatcaccgaggtggaccgcaccgaggcgaaggaggggctgaagcggggcgagatcacgcaccacgccgtcagccgcggctccgccaagctgcagtggttcgtggagcggaacatggtgatcccggaggggcgcgtcatcgacctcggctgcgggcggggcgggtggagctactactgcgccggcctgaagaaggtgaccgaggtgcgcggctacaccaagggcgggcccgggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccggaccatccgcgtgctgaagatggtggagccgtggctcaagaacaaccagttctgcatcaaggtcctgaacccctacatgcccaccgtgatcgagcacctggagcgcctccagcggaagcacggcgggatgctggtgcgcaaccccctgtcccggaacagcacgcacgagatgtactggatctccaacggcaccgggaacatcgtcgccagcgtgaacatggtgtcccgcctcctgctgaaccggttcaccatgacccaccgccggccgacgatcgagaaggacgtcgacctcggcgcgggcacccgccacgtgaacgccgagcccgagacccccaacatggacgtgatcggggagcggatcaagcgcatcaaggaggagcacaacagcacctggcactacgacgacgagaacccgtaccggacgtgggcctaccacggctcctacgaggtcaaggccaccgggagcgcctccagcatgatcaacggcgtggtcaagctgctgaccaagccctgggacgtggtgcccatggtcacccagatggcgatgacggacaccacccccttcgggcagcagcgcgtgttcaaggagaaggtggacacccggacgccgcgctccatgcccggcacccggcgcgtcatgggcatcaccgccgagtggctctggcggaccctggggcgcaacaagaagccccggctgtgcacgcgcgaggagttcaccaagaaggtgcgcaccaacgccgccatgggcgcggtgttcaccgaggagaaccagtgggacagcgccaaggccgccgtcgaggacgaggacttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacacggcggggtgggacacccgcatcaccgaggacgacctgcacaacgaggagaagatcacccagcagatggacccggagcaccggcagctcgccaacgccatcttcaagctgacctaccagaacaaggtggtgaaggtccagcgccccacgcccaccggcaccgtgatggacatcatcagccggaaggaccagcgcggctccggccaggtgggcacctacgggctgaacacgttcaccaacatggaggcccagctcatccggcagatggagggcgagggggtcctgagcaaggccgacctggagaacccccacctcccggagaagaagatcacccagtggctggagaccaagggcgtggagcgcctgaagcggatggcgatctccggcgacgactgcgtggtcaagcccatcgacgaccgcttcgccaacgccctcctggccctgaacgacatggggaaggtgcggaaggacatcccccagtggcagcccagcaagggctggcacgactggcagcaggtcccgttctgctcccaccacttccacgagctcatcatgaaggacgggcgcaagctggtcgtgccctgccggccccaggacgagctgatcggccgcgcccggatcagccagggggcgggctggtccctccgcgagacggcctgcctgggcaaggcctacgcccagatgtggagcctgatgtacttccaccgccgggacctccgcctggcgtccaacgccatctgcagcgccgtgcccgtccactgggtgccgacctcccggaccacctggagcatccacgcccaccaccagtggatgacgaccgaggacatgctgaccgtgtggaaccgcgtctggatcgaggacaacccctggatggaggacaagacccccgtgacgacctgggagaacgtgccctacctcgggaagcgggaggaccagtggtgcggctccctgatcgggctgaccagccgcgccacctgggcgcagaacatcccgacggccatccagcaggtccggagcctcatcggcaacgaggagttcctggactacatgccctccatgaagcgcttccggaaggaggaggagagcgagggggccatctggtga

SEQ ID NO: 10293 - RNA, 9873 nt, synthetic construct
  misc_feature 1..9873: note = derived and/or modified CDS sequence (opt1) from DENV-3__EU482452__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctccccgaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcgacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctcctgtggaagcagatcgccaacgagctgaactacatcctctgggagaacaacatcaagctgacggtcgtggtgggggacgtcatcggcgtgctggagcagggcaagcgcaccctcacgccccagccgatggagctgaagtactcctggaagacctgggggaaggcgaagatcgtgacggccgagacccagaacagctccttcatcatcgacggcctgaacacccccgagtgccccagcgcctcccgggcctggaacgtctgggaggtggaggactacgggttcggcgtgttcaccacgaacatctggctcaagctgcgcgaggtctacacccagagctgcgaccaccggctgatgagcgcggccatcaaggacgagcgcgccgtgcacgccgacatgggctactggatcgagtcccagaagaacgggagctggaagctcgagaaggcctccttcatcgaggtgaagacctgcacctggcccaagagccacaccctgtggtccaacggcgtcctggagagcgacatgatcatcccgaagtccctcgcggggcccatcagccagcacaaccaccggcccggctaccacacgcagaccgccgggccgtggcacctgggcaagctggagctcgacttcaactactgcgagggcaccaccgtggtgatcacggagaactgcgggacccgcggcccctccctgcggaccaccacggtcagcgggaagctgatccacgagtggtgctgccgctcctgcaccctgccgcccctccggtacatgggcgaggacgggtgctggtacggcatggagatccgcccgatcaacgagaaggaggagaacatggtcaagagcctggtgtccgccggcagcgggaaggtggacaacttcaccatgggcgtgctctgcctggccatcctgttcgaggaggtgatgcgggggaagttcggcaagaagcacatgatcgccggggtcctcttcaccttcgtgctgctgctctccggccagatcacgtggcgcgacatggcgcacaccctgatcatgatcggcagcaacgcctccgaccggatggggatgggcgtgacctacctggccctcatcgccaccttcaagatccagcccttcctggccctggggttcttcctccgcaagctgacgagccgggagaacctgctcctgggcgtcggcctggcgatggccaccaccctccagctgcccgaggacatcgagcagatggccaacgggatcgccctgggcctcatgaccctgaagctgatcacgcagttcgagacctaccagctctggaccgcgctggtgagcctgacctgctccaacacgatcttcaccctcaccgtcgcctggcgcaccgccacgctgatcctggccggggtgagcctcctgcccctgtgccagtccagctccatgcggaagaccgactggctcccgatgaccgtggccgcgatgggcgtcagccccctgcccctgttcatcttctccctcaaggacacccccaagcgccgcagctggccgctgaacgagggggtgatggccgtgggcctggtctccatcctcgccagctccctgctgcggaacgacgtgcccatggccggccccctcgtggccgggggcctgctgatcgcgtgctacgtcatcacggggaccagcgccgacctcaccgtggagaaggccgccgacgtgacctgggaggaggaggccgagcagacgggcgtctcccacaacctgatgatcaccgtggacgacgacgggaccatgcgcatcaaggacgacgagaccgagaacatcctgaccgtgctcctgaagacggcgctgctcatcgtcagcggcatcttcccctactccatcccggccaccctgctggtgtggcacacctggcagaagcagacccagcggagcggcgtgctctgggacgtccccagcccgcccgagacgcagaaggccgagctggaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctcgagccgaactgggccagcgtgaagaaggacctgatctcctacggcgggggctggcggctgagcgcgcagtggcagaagggggaggaggtccaggtgatcgccgtggagcccggcaagaaccccaagaacttccagaccatgcccggcatcttccagaccaccacgggggagatcggcgccatcgccctggacttcaagccggggaccagcggctcccccatcatcaaccgcgagggcaaggtcgtggggctctacggcaacggggtggtcaccaagaacggcgggtacgtgagcggcatcgcgcagaccaacgccgagcccgacggcccgacgcccgagctggaggaggagatgttcaagaagcggaacctgaccatcatggacctccaccccgggtccggcaagacccgcaagtacctgcccgccatcgtgcgggaggccatcaagcgccggctgcgcaccctcatcctggccccgacgcgggtcgtggcggccgagatggaggaggccctgaaggggctccccatccgctaccagaccaccgccaccaagagcgagcacacgggccgggagatcgtggacctgatgtgccacgccaccttcaccatgcgcctgctctcccccgtccgggtgcccaactacaacctgatcatcatggacgaggcgcacttcaccgacccggccagcatcgccgcccgcgggtacatctccacgcgggtgggcatgggcgaggccgcggccatcttcatgaccgccacgccgcccgggaccgccgaggcgttcccccagagcaacgccccgatccaggacgaggagcgcgacatccccgagcgctcctggaacagcggcaacgagtggatcacggacttcgtcgggaagaccgtgtggttcgtgccctccatcaaggccggcaacgacatcgccaactgcctgcggaagaacgggaagaaggtcatccagctcagccgcaagaccttcgacaccgagtaccagaagacgcggctgaacgactgggacttcgtggtgaccaccgacatctccgagatgggcgccaacttcaaggcggaccgcgtcatcgacccccggcgctgcctgaagccggtgatcctcaccgacggccccgagcgggtgatcctggccgggcccatgcccgtcacggccgccagcgccgcgcagcgccggggccgcgtggggcggaacccgcagaaggagaacgaccagtacatcttcaccggccagcccctgaacaacgacgaggaccacgcccactggaccgaggccaagatgctcctggacaacatcaacacccccgaggggatcatccccgccctgttcgagccggagcgcgagaagtccgccgcgatcgacggcgagtaccggctcaagggcgagagccgcaagaccttcgtcgagctgatgcggcgcggggacctgcccgtgtggctcgcccacaaggtggcctccgagggcatcaagtacacggaccggaagtggtgcttcgacggggagcgcaacaaccagatcctggaggagaacatggacgtcgagatctggaccaaggagggcgagcggaagaagctgcgcccccgctggctcgacgcccggacctacagcgaccccctggcgctgaaggagttcaaggacttcgccgccggccgcaagtccatcgccctcgacctggtgaccgagatcgggcgggtgccgagccacctggcctaccgcacgcggaacgcgctcgacaacctggtcatgctgcacaccagcgagcacggcgggcgcgcctaccggcacgccgtggaggagctccccgagaccatggagaccctgctgctcctgggcctgatgatcctcctgaccggcggggccatgctgttcctcatctccgggaaggggatcggcaagaccagcatcgggctgatctgcgtgatcgtctccagcggcatgctgtggatggccgacatccccctccagtggatcgcgtccgccatcgtgctggagttcttcatgatggtgctgctcatcccggagcccgagaagcagcgcacgccccaggacaaccagctggcctacgtcgtgatcgggatcctgaccctcgccgccatcgtggcggccaacgagatgggcctgctggagacgaccaagcgggacctcggcatgagcaaggagcccggggtcgtgtccccgaccagctacctggacgtggacctgcaccccgcctccgcctggaccctctacgccgtcgcgacgaccgtgatcacccccatgctgcgccacaccatcgagaacagcacggccaacgtgtccctggccgccatcgcgaaccaggccgtcgtgctcatgggcctggacaaggggtggcccatcagcaagatggacctgggcgtgccgctcctggccctggggtgctactcccaggtcaaccccctcaccctgaccgccgccgtgctgctcctggtgacccactacgcgatcatcggccccggcctgcaggccaaggccacgcgggaggcccagaagcgcaccgccgcggggatcatgaagaaccccaccgtcgacggcatcatgaccatcgacctcgacccggtgatctacgacagcaagttcgagaagcagctgggccaggtgatgctgctcgtcctgtgcgccgtgcagctgctcctgatgcggacgtcctgggccctgtgcgaggccctcaccctggccaccggccccatcaccacgctgtgggagggcagccccgggaagttctggaacaccaccatcgcggtgtccatggccaacatcttccgcggcagctacctcgccggggccggcctggcgttctccatcatgaagtccgtcgggaccggccggcgcggcacggggagccagggcgagaccctgggggagaagtggaagaagaagctcaaccagctgtcccggaaggagttcgacctgtacaagaagtccggcatcaccgaggtggaccgcaccgaggccaaggaggggctcaagcggggcgagaccacgcaccacgccgtgtcccgcggcagcgccaagctgcagtggttcgtcgagcggaacatggtgatccccgaggggcgcgtgatcgacctgggctgcgggcgcggcgggtggtcctactactgcgccggcctcaagaaggtcaccgaggtgcggggctacaccaagggcgggccggggcacgaggagcccgtgcccatgagcacctacggctggaacatcgtcaagctgatgtccgggaaggacgtgttctacctgcccccggagaagtgcgacacgctgctctgcgacatcggcgagagctcccccagccccaccgtggaggagtcccgcaccatccgggtcctgaagatggtggagccctggctgaagaacaaccagttctgcatcaaggtgctcaacccgtacatgcccaccgtcatcgagcacctggagcgcctgcagcggaagtacggcgggatgctcgtgcgcaaccccctgagccggaactccacgcacgagatgtactggatcagcaacggcaccgggaacatcgtgtccagcgtcaacatggtgtcccgcctgctcctgaaccggttcaccatgacccaccgccggcccacgatcgagaaggacgtcgacctgggcgcgggcacccgccacgtgaacgccgagccggagacccccaacatggacgtgatcggggagcggatcaagcgcatcaaggaggagcacagctccacctggcactacgacgacgagaacccctacaagacgtgggcctaccacggcagctacgaggtcaaggccaccgggagcgcctccagcatgatcaacggcgtggtgaagctcctgaccaagccgtgggacgtcgtgcccatggtgacccagatggcgatgacggacaccacccccttcgggcagcagcgggtcttcaaggagaaggtggacacccgcacgccccggccgatgcccggcacccgcaaggtgatggagatcaccgccgagtggctgtggcggaccctcggccgcaacaagaagccccgcctgtgcacgcgggaggagttcaccaagaaggtccgcaccaacgccgccatgggggccgtgttcaccgaggagaaccagtgggactccgcgcgggccgccgtggaggacgaggagttctggaagctggtcgaccgcgagcgggagctccacaagctgggcaagtgcgggagctgcgtgtacaacatgatgggcaagcgcgagaagaagctgggggagttcggcaaggccaagggctcccgggcgatctggtacatgtggctcggggcccgctacctggagttcgaggccctgggcttcctcaacgaggaccactggttcagccgggagaactcctacagcggggtggagggcgaggggctgcacaagctgggctacatcctccgcgacatctccaagatccccggcggggccatgtacgccgacgacacggcgggctgggacacccggatcaccgaggacgacctgcacaacgaggagaagatcacccagcagatggacccggagcaccgccagctggccaacgccatcttcaagctcacgtaccagaacaaggtcgtgaaggtgcagcggcccacccccaaggggaccgtcatggacatcatcagccgcaaggaccagcggggctccggccaggtggggacctacggcctgaacaccttcacgaacatggaggcccagctggtgcgccagatggagggggagggcgtcctcagcaaggccgacctggagaacccccacctcctggagaagaagatcacccagtggctggagaccaagggggtggagcggctgaagcgcatggcgatctccggcgacgactgcgtggtcaagccgatcgacgaccggttcgccaacgccctcctggccctgaacgacatgggcaaggtgcgcaaggacatcccccagtggcagcccagcaaggggtggcacgactggcagcaggtccccttctgctcccaccacttccacgagctcatcatgaaggacggccggaagctggtcgtgccgtgccgcccccaggacgagctgatcgggcgcgcccggatcagccagggcgcggggtggtccctcaaggagaccgcctgcctgggcaaggcctacgcccagatgtggagcctgatgtacttccaccgccgggacctccgcctggcctccaacgcgatctgcagcgccgtgcccgtccactggatccccacgagccggaccacctggtccatccacgcccaccaccagtggatgaccacggaggacatgctgaccgtgtggaaccgcgtgtggatcgaggacaacccgtggatggaggacaagacccccgtcaccacgtgggaggacgtgccctacctcggcaagcgggaggaccagtggtgcgggagcctgatcggcctgacctcccgcgccacctgggcgcagaacatcctcaccgccatccagcaggtccggagcctgatcggggacgaggagttcctggactacatgccctccatgaagcgcttccggaaggaggaggagagcgagggcgccatctggtga

SEQ ID NO: 10294 - RNA, 9873 nt, synthetic construct
  misc_feature 1..9873: note = derived and/or modified CDS sequence (opt1) from DENV-3__EU482453__SS-prME
  source 1..9873: mol_type = other RNA
accagcctgtgcctcatcatgatgctgcccgccaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgccatcgggatcatcaccctgtacctcggcgccgtggtccaggccgacatggggtgcgcgatcaactggaagggcaaggagctgaagtgcggcagcgggatcttcgtgaccaacgaggtgcacacctggacggagcagtacaagttccaggccgactcccccaagcgcctggccaccgccatcgccggcgcgtgggagaacggggtctgcggcatccgcagcaccacccggatggagaacctcctgtggaagcagatcgccaacgagctgaactacatcctctgggagaacaacatcaagctgacggtggtggtcggggacatcatcggcgtgctggagcagggcaagcgcaccctcacgccccagccgatggagctgaagtactcctggaagacctgggggaaggccaagatcgtgacggccgagacccagaacagctccttcatcatcgacggccccaacacccccgagtgccccagcgcgtcccgggcctggaacgtctgggaggtggaggactacgggttcggcgtgttcaccacgaacatctggctgaagctccgcgaggtctacacccagagctgcgaccaccggctgatgagcgccgccatcaaggacgagcgcgccgtgcacgcggacatgggctactggatcgagtcccagaagaacgggagctggaagctggagaaggcctccttcatcgaggtgaagacctgcacctggcccaagagccacaccctctggtccaacggcgtcctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtgatcacggagaactgcgggacccgcggcccctccctccggaccaccacggtcagcgggaagctgatccacgagtggtgctgccgctcctgcaccctgcccccgctccggtacatgggcgaggacgggtgctggtacggcatggagatccgccccaccaacgagaaggaggagaacatggtcaagagcctggtgtccgccggcagcgggaaggtcgacaacttcaccatgggcgtgctgtgcctcgcgatcctgttcgaggaggtgatgcgggggaagttcggcaagaagcacatgatcgccggggtcctgttcacgttcgtgctcctgctgtccggccagatcacctggcgcgacatggcccacaccctcatcatgatcggcagcaacgcctccgaccggatggggatgggcgtgacctacctggccctgatcgcgacgttcaagatccagcccttcctcgccctggggttcttcctgcgcaagctcaccagccgggagaacctgctgctcggcgtcggcctggccatggccaccaccctgcagctccccgaggacatcgagcagatggcgaacgggatcgccctgggcctgatgacgctcaagctgatcacccagttcgagacctaccagctgtggaccgccctcgtgagcctgacgtgctccaacaccatcttcaccctgaccgtggcctggcgcacggccaccctcatcctggcgggggtcagcctgctcccgctgtgccagtccagctccatgcggaagaccgactggctgcccatgaccgtggccgccatgggcgtgccgcccctgccgctgttcatcttcagcctgaaggacacgcccaagcgccgctcctggcccctcaacgagggggtgatggccgtgggcctggtcagcatcctggcctccagcctcctgcggaacgacgtgcccatggcgggcccgctggtggccgggggcctcctgatcgcctgctacgtcatcaccgggacctccgccgacctgaccgtggagaaggccgcggacgtgacgtgggaggaggaggccgagcagaccggcgtcagccacaacctcatgatcaccgtggacgacgacgggaccatgcgcatcaaggacgacgagaccgagaacatcctgacggtgctgctcaagaccgccctgctgatcgtctccggcatcttcccctacagcatccccgccaccctcctggtgtggcacacctggcagaagcagacgcagcggtccggcgtgctgtgggacgtccccagcccgcccgagacccagaaggccgagctcgaggagggggtgtaccgcatcaagcagcagggcatcttcgggaagacccaggtgggcgtcggggtgcagaaggagggcgtgttccacaccatgtggcacgtcacgcggggcgcggtgctgacccacaacgggaagcgcctggagcccaactgggcctccgtgaagaaggacctcatcagctacggcgggggctggcggctgtccgcccagtggcagaagggggaggaggtccaggtgatcgccgtggagcccggcaagaacccgaagaacttccagaccatgcccggcatcttccagaccacgaccggggagatcggcgcgatcgccctggacttcaagcccgggaccagcggcagcccgatcatcaaccgcgagggcaaggtcgtggggctgtacggcaacggggtggtcaccaagaacggcgggtacgtgtccggcatcgcccagacgaacgccgagcccgacggccccacccccgagctcgaggaggagatgttcaagaagcggaacctgaccatcatggacctgcacccggggagcggcaagacccgcaagtacctccccgccatcgtgcgggaggcgatcaagcgccggctgcgcacgctgatcctcgcccccacccgggtcgtggccgccgagatggaggaggccctgaaggggctgcccatccgctaccagaccaccgcgacgaagtccgagcacaccggccgggagatcgtggacctcatgtgccacgccaccttcaccatgcgcctgctgagcccggtccgggtgcccaactacaacctcatcatcatggacgaggcccacttcacggaccccgcctccatcgccgcgcgcgggtacatcagcacccgggtgggcatgggcgaggccgccgccatcttcatgaccgcgacgccgcccgggacggccgaggccttcccccagtccaacgcccccatccaggacgaggagcgcgacatccccgagcgcagctggaactccggcaacgagtggatcaccgacttcgtcgggaagaccgtgtggttcgtgcccagcatcaaggccggcaacgacatcgcgaactgcctgcggaagaacgggaagaaggtcatccagctgtcccgcaagaccttcgacacggagtaccagaagacccggctcaacgactgggacttcgtggtgaccaccgacatcagcgagatgggcgccaacttcaaggccgaccgcgtcatcgacccccggcgctgcctgaagcccgtgatcctgacggacggccccgagcgggtgatcctcgccgggccgatgcccgtcaccgccgcgtccgccgcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgcgctgttcgagcccgagcgcgagaagtccgccgccatcgacggcgagtaccggctgaagggcgagtcccgcaagacgttcgtggagctcatgcggcgcggggacctgcccgtctggctggcccacaaggtggcgagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcccggacctactccgaccccctcgccctgaaggagttcaaggacttcgccgccggccgcaagagcatcgcgctggacctcgtgacggagatcgggcgggtgccctcccacctggcctaccgcacccggaacgccctggacaacctcgtcatgctgcacaccagcgagcacggcgggcgcgcctaccggcacgccgtggaggagctgccggagaccatggagacgctcctgctgctcggcctgatgatcctgctcaccgggggcgcgatgctgttcctgatcagcggcaaggggatcggcaagacctccatcgggctcatctgcgtgatcgtcagctccggcatgctgtggatggccgacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgacgctggcggccatcgtcgccgccaacgagatgggcctcctggagaccaccaagcgggacctgggcatgtccaaggagcccggggtggtgagccccacctcctacctcgacgtcgacctgcaccccgccagcgcgtggacgctgtacgccgtggccaccaccgtgatcaccccgatgctccgccacacgatcgagaactccaccgccaacgtcagcctggcggccatcgccaaccaggccgtggtgctgatgggcctcgacaaggggtggcccatctccaagatggacctgggcgtccccctgctcgccctggggtgctacagccaggtgaaccccctgaccctcaccgcggccgtgctgctgctcgtcacgcactacgccatcatcggcccgggcctgcaggccaaggccacccgggaggcgcagaagcgcaccgccgccgggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggcgctgaccctcgccaccggccccatcacgaccctgtgggagggctccccggggaagttctggaacaccaccatcgccgtcagcatggccaacatcttccgcggctcctacctggcgggggccggcctcgccttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtcagccgcggctccgcgaagctccagtggttcgtggagcggaacatggtgatccccgaggggcgcgtcatcgacctgggctgcgggcgcggcgggtggagctactactgcgccggcctgaagaaggtgaccgaggtgcggggctacaccaagggcgggcccgggcacgaggagcccgtcccgatgtccacgtacggctggaacatcgtgaagctcatgagcgggaaggacgtgttctacctgccgcccgagaagtgcgacaccctgctgtgcgacatcggcgagtccagcccctccccgaccgtcgaggagagccgcaccatccgggtgctcaagatggtggagccctggctgaagaacaaccagttctgcatcaaggtcctgaacccctacatgcccacggtgatcgagcacctcgagcgcctgcagcggaagtacggcgggatgctggtgcgcaacccgctctcccggaacagcacccacgagatgtactggatctccaacggcaccgggaacatcgtcagctccgtgaacatggtgagccgcctgctgctcaaccggttcaccatgacgcaccgccggcccaccatcgagaaggacgtcgacctgggcgccggcacccgccacgtgaacgccgagcccgagaccccgaacatggacgtcatcggggagcggatcaagcgcatcaaggaggagcactccagcacgtggcactacgacgacgagaacccctacaagacctgggcctaccacggctcctacgaggtgaaggcgaccgggagcgccagctccatgatcaacggcgtggtcaagctgctcaccaagccctgggacgtggtgcccatggtcacgcagatggccatgaccgacaccaccccgttcgggcagcagcgggtgttcaaggagaaggtggacacgcgcacgccccggcccatgcccggcacccgcaaggtcatggagatcaccgccgagtggctgtggcggacgctgggccgcaacaagaagccgcgcctctgcacccgggaggagttcaccaagaaggtgcgcaccaacgccgcgatgggggccgtgttcacggaggagaaccagtgggacagcgcccgggccgcggtcgaggacgaggagttctggaagctggtggaccgcgagcgggagctgcacaagctcggcaagtgcgggtcctgcgtgtacaacatgatgggcaagcgcgagaagaagctgggggagttcggcaaggccaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggcgatgtacgccgacgacaccgccggctgggacacccggatcaccgaggacgacctccacaacgaggagaagatcacgcagcagatggaccccgagcaccgccagctggccaacgccatcttcaagctgacctaccagaacaaggtggtgaaggtccagcggcccaccccgaaggggaccgtgatggacatcatctcccgcaaggaccagcggggcagcggccaggtggggacctacggcctcaacacgttcaccaacatggaggcgcagctggtccgccagatggagggggagggcgtgctgtccaaggccgacctcgagaacccccacctcctggagaagaagatcacccagtggctcgagaccaagggggtggagcggctgaagcgcatggccatcagcggcgacgactgcgtcgtgaagcccatcgacgaccggttcgccaacgccctgctcgcgctgaacgacatgggcaaggtgcgcaaggacatcccccagtggcagccgtccaaggggtggcacgactggcagcaggtccccttctgcagccaccacttccacgagctgatcatgaaggacggccggaagctcgtggtgccctgccgcccccaggacgagctgatcgggcgcgcccggatctcccagggcgccgggtggagcctgaaggagacggcctgcctcggcaaggcctacgcgcagatgtggtccctgatgtacttccaccgccgggacctgcgcctcgccagcaacgccatctgctccgccgtcccggtgcactggatccccaccagccggaccacctggagcatccacgcgcaccaccagtggatgacgaccgaggacatgctgaccgtgtggaaccgcgtctggatcgaggacaacccctggatggaggacaagacccccgtgacgacctgggaggacgtgccgtacctgggcaagcgggaggaccagtggtgcgggtccctcatcggcctgaccagccgcgccacctgggcccagaacatcctgacggccatccagcaggtccggtccctcatcggggacgaggagttcctggactacatgcccagcatgaagcgcttccggaaggaggaggagctggagggcgccatctggtga

SEQ ID NO: 10295 - RNA, 9873 nt, synthetic construct
  misc_feature 1..9873: note = derived and/or modified CDS sequence (opt1) from DENV-3__EU482454__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccaccctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcaccccccaggccagcaccgtggaggccgtgctgcccgagtacggcaccctcgggctggagtgctccccgcgcaccggcctggacttcaacgagatgatcctcctgacgatgaagaacaaggcgtggatggtccaccggcagtggttcttcgacctgcccctcccctggaccagcggcgccaccaccgagacgcccacctggaaccgcaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtctccgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagagcaacatcgtgatcggcatcggggacaaggccctcaagatcaactggtacaagaagggctccagcatcgggaagatgttcgaggcgaccgccaagggcgcccggcgcatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacgtggaccgagcagtacaagttccaggccgactcccccaagcggctggcgaccgccatcgccggcgcctgggagaacggggtgtgcggcatccgcagcaccacgcgcatggagaacctcctgtggaagcagatcgccaacgagctgaactacatcctctgggagaacaacatcaagctgaccgtcgtggtgggggacatcatcggcgtcctggagcagggcaagcggaccctcaccccccagccgatggagctgaagtactcctggaagacgtgggggaaggcgaagatcgtgaccgccgagacccagaacagctccttcatcatcgacggccccaacacccccgagtgccccagcgcctcccgcgcctggaacgtgtgggaggtcgaggactacgggttcggcgtgttcacgaccaacatctggctgaagctccgggaggtgtacacccagagctgcgaccaccgcctgatgagcgcggccatcaaggacgagcgggccgtccacgccgacatgggctactggatcgagtcccagaagaacgggagctggaagctggagaaggcctccttcatcgaggtgaagacctgcacctggccgaagagccacacgctctggtccaacggcgtgctggagagcgacatgatcatccccaagtccctggcggggcccatcagccagcacaaccaccgcccgggctaccacacccagaccgccgggccctggcacctcggcaagctggagctggacttcaactactgcgagggcaccacggtcgtgatcaccgagaactgcgggacccggggcccctccctccgcaccacgaccgtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgccggggtgctgttcacgttcgtcctcctgctgtccggccagatcacctggcgggacatggcgcacaccctcatcatgatcggcagcaacgcctccgaccgcatggggatgggcgtgacctacctggccctgatcgccacgttcaagatccagcccttcctcgccctggggttcttcctgcggaagctcaccagccgcgagaacctgctgctcggcgtgggcctggcgatggccaccaccctgcagctccccgaggacatcgagcagatggccaacgggatcgccctgggcctgatgacgctcaagctgatcacccagttcgagacctaccagctgtggaccgcgctcgtcagcctgacgtgctccaacaccatcttcaccctgaccgtggcctggcggacggccaccctcatcctggccggggtcagcctgctcccgctgtgccagtccagctccatgcgcaagaccgactggctgcccatgaccgtggccgcgatgggcgtgccccccctcccgctgttcatcttcagcctgaaggacacgcccaagcggcgctcctggcccctcaacgagggggtcatggccgtgggcctggtgagcatcctggcctccagcctcctgcgcaacgacgtccccatggccggcccgctggtggccgggggcctcctgatcgcgtgctacgtgatcaccgggacctccgccgacctgaccgtcgagaaggccgccgacgtgacgtgggtggaggaggccgagcagaccggcgtcagccacaacctcatgatcaccgtggacgacgacgggaccatgcggatcaaggacgacgagaccgagaacatcctgacggtgctgctcaagaccgcgctgctgatcgtctccggcatcttcccctacagcatccccgccaccctcctggtgtggcacacctggcagaagcagacgcagcgctccggcgtgctgtgggacgtccccagcccgcccgagacccagaaggccgagctcgaggagggggtgtaccggatcaagcagcagggcatcttcgggaagacccaggtgggcgtcggggtgcagcgcgagggcgtgttccacaccatgtggcacgtcacgcggggcgccgtgctgacccacaacgggaagcgcctggagcccaactgggcctccgtgaagaaggacctcatcagctacggcgggggctggcggctgtccgcgcagtggcagaagggggaggaggtccaggtgatcgccgtggagcccggcaagaacccgaagaacttccagaccatgcccggcaccttccagacgaccaccggggagatcggcgccatcgccctggacttcaagcccgggaccagcggcagcccgatcatcaaccgcgagggcaaggtcgtggggctgtacggcaacggggtggtcacgaagaacggcgggtacgtgtccggcatcgcgcagaccaacgccgagcccgacggccccacccccgagctcgaggaggagatgttcaagaagcggaacctgaccatcatggacctgcacccggggagcggcaagacgcgcaagtacctccccgccatcgtgcgggaggccatcaagcgccggctgcgcaccctgatcctcgcccccacccgggtcgtggcggccgagatggaggaggccctgaaggggctgcccatccgctaccagaccacggccaccaagtccgagcacaccggccgggagatcgtggacctcatgtgccacgccaccttcacgatgcgcctgctgagcccggtccgggtgcccaactacaacctcatcatcatggacgaggcgcacttcaccgaccccgcctccatcgccgcccgcgggtacatcagcacccgggtgggcatgggcgaggccgcggccatcttcatgaccgccacgcccccggggaccgccgaggcgttcccccagtccaacgcccccatccaggacgaggagcgcgacatccccgagcgcagctggaactccggcaacgagtggatcaccgacttcgtcgggaagaccgtgtggttcgtgccgagcatcaaggccggcaacgacatcgccaactgcctgcggaagaacgggaagaaggtcatccagctgtcccgcaagacgttcgacaccgagtaccagaagacccggctcaacgactgggacttcgtggtgaccacggacatcagcgagatgggcgccaacttcaaggcggaccgcgtcatcgacccccggcgctgcctgaagcccgtgatcctgaccgacggccccgagcgggtgatcctcgccgggccgatgcccgtcaccgccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacacgccggaggggatcatccccgccctgttcgagcccgagcgcgagaagagcgccgcgatcgacggcgagtaccggctgaagggcgagtcccgcaagaccttcgtcgagctcatgcggcgcggggacctgcccgtgtggctggcccacaaggtggccagcgagggcatcaagtacaccgaccggaagtggtgcttcgacggggagcgcaacaaccagatcctcgaggagaacatggacgtcgagatctggaccaaggagggcgagcggaagaagctgcgcccgcgctggctggacgcccggacgtactccgaccccctcgcgctgaaggagttcaaggacttcgccgccggccgcaagagcatcgccctggacctcgtgaccgagatcgggcgggtgccctcccacctggcccaccgcacccggaacgcgctggacaacctcgtcatgctgcacaagagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatggggctcatctgcgtgatcgtcagctccggcatgctgtggatggccgacgtgcccctgcagtggatcgcgagcgccatcgtgctcgagttcttcatgatggtcctgctgatccccgagcccgagaagcagcgcaccccgcaggacaaccagctcgcctacgtggtgatcgggatcctgacgctggccgccatcgtcgcggccaacgagatgggcctcctggagaccaccaagcgggacctgggcatgtccaaggagcccggggtggtgagccccacctcctacctcgacgtcgacctgcaccccgccagcgcctggacgctgtacgccgtggcgaccaccgtgatcaccccgatgctccgccacacgatcgagaactccaccgccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacgcactacgcgatcatcggcccgggcctgcaggccaaggccacccgggaggcccagaagcgcaccgccgcggggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgccaccggccccatcacgaccctgtgggagggctccccggggaagttctggaacaccaccatcgcggtcagcatggccaacatcttccgcggctcctacctggccggggccggcctcgcgttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtcagccgcggctccgccaagctccagtggttcgtggagcggaacatggtgatccccgaggggcgcgtcatcgacctgggctgcgggcgcggcgggtggagctactactgcgccggcctgaagaaggtgaccgaggtgcggggctacaccaaggggggccccgggcacgaggagcccgtcccgatgtccacgtacggctggaacatcgtgaagctcatgagcgggaaggacgtgttctacctgccccccgagaagtgcgacaccctgctgtgcgacatcggcgagtccagcccctccccgaccgtcgaggagagccgcaccatccgggtgctcaagatggtggagccctggctgaagaacaaccagttctgcatcaaggtcctgaacccctacatgcccacggtgatcgagcacctcgagcgcctgcagcggaagtacggcgggatgctggtgcgcaacccgctctcccggaacagcacccacgagatgtactggatctccaacggcaccgggaacatcgtcagctccgtgaacatggtcagccgcctgctgctcaaccggttcaccatgacgcaccgccggcccaccatcgagaaggacgtggacctgggcgcgggcacccgccacgtgaacgccgagcccgagaccccgaacatggacgtcatcggggagcggatcaagcgcatcaaggaggagcactccagcacgtggcactacgacgacgagaacccctacaagacctgggcctaccacggctcctacgaggtgaaggccaccgggagcgccagctccatgatcaacggcgtggtcaagctgctcaccaagccctgggacgtggtgcccatggtcacgcagatggcgatgaccgacaccaccccgttcgggcagcagcgggtgttcaaggagaaggtggacacgcgcaccccccggcccatgcccggcacccgcaaggtcatggagatcaccgccgagtggctgtggcggacgctgggccgcaacaagaagccgcgcctctgcacccgggaggagttcaccaagaaggtgcgcaccaacgccgccatgggggccgtgttcacggaggagaaccagtgggacagcgcgcgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgccgacgacaccgcgggctgggacacccggatcaccgaggacgacctccacaacgaggagaagatcacgcagcagatggaccccgagcaccgccagctggccaacgccatcttcaagctgacctaccagaacaaggtggtgaaggtccagcggcccaccccgaaggggaccgtgatggacatcatctcccgcaaggaccagcggggcagcggccaggtggggacctacggcctcaacacgttcaccaacatggaggcccagctggtccgccagatggagggggagggcgtgctgtccaaggccgacctcgagaacccccacctgctggagaagcggatcacccagtggctcgagaccaagggggtggagcgcctgaagcggatggcgatcagcggcgacgactgcgtcgtgaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtggtgccctgccgcccccaggacgagctgatcgggcgggcccgcatctcccagggcgcggggtggagcctgaaggagacggcctgcctcggcaaggcctacgcccagatgtggtccctgatgtacttccaccggcgcgacctgcggctcgccagcaacgcgatctgctccgccgtcccggcccactggatccccaccagccgcaccacctggagcatccacgcccaccaccagtggatgacgaccgaggacatgctgaccgtgtggaaccgggtgtggatcgaggacaacccctggatggaggacaagacccccgtcacgacctgggaggacgtgccgtacctgggcaagcgcgaggaccagtggtgcgggtccctcatcggcctgaccagccgggcgacctgggcccagaacatcctgacggccatccagcaggtgcgctccctcatcggggacgaggagttcctggactacatgcccagcatgaagcggttccgcaaggaggaggagtccgagggcgccatctggtga

SEQ ID NO: 10296 - RNA, 9873 nt, synthetic construct
  misc_feature 1..9873: note = derived and/or modified CDS sequence (opt1) from DENV-3__EU482455__SS-prME
  source 1..9873: mol_type = other RNA
accagcctctgcctcatgatgatgctccccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctggtggccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcggcaggtcgagaaggtggagacgtgggccctccgccacccggggttcaccatcctggcgctgttcctcgcccactacatcggcacctccctgacccagaaggtggtcatcttcatcctgctcatgctggtgacgcccagcatgaccatgcggtgcgtgggggtcggcaaccgcgacttcgtggagggcctgtccggggccacctgggtggacgtcgtgctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtctgcaagcacacctacgtggaccgggggtggggcaacgggtgcggcctgttcgggaagggctccctggtgacctgcgccaagttccagtgcctcgagcccatcgagggcaaggtcgtgcagtacgagaacctgaagtacaccgtgatcatcacggtccacaccggggaccagcaccaggtgggcaacgacacccagggggtcaccgtggagatcacgccccaggccagcaccgtggaggccgtcctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaacaagaaggagctgctggtgaccttcaagaacgcccacgccaagaagcaggaggtcgtggtgctcgggtcccaggagggcgccatgcacaccgcgctgaccggggccacggagatccagaacagcggcgggacctccatcttcgccggccacctgaagtgccgcctcaagatggacaagctggagctgaagggcatgagctacgccatgtgcctcaacaccttcgtcctgaagaaggaggtgtccgagacccagcacgggacgatcctgatcaaggtggagtacaagggcgaggacgccccgtgcaagatccccttcagcaccgaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaaggccctcaagatcaactggtacaagaagggctccagcatcgggaagatgttcgaggcgacggcccgcggcgcccggcgcatggccatcctgggcgacaccgcctgggacttcgggtccgtgggcggggtgctgaacagcctcggcaagatggtccaccagatcttcgggtccgcgtacaccgccctgttcagcggcgtgtcctggatcatgaagatcggcatcggggtgctgctcacctggatcggcctgaacagcaagaacacgtccatgagcttctcctgcatcgtcatcgggatcatcaccctgtacctcggcgccgtggtgcaggccgacatggggtgcgccatcaactggaagggcaaggagctgaagtgcggcagcgggatcttcgtcaccaacgaggtgcacacctggacggagcagtacaagttccaggcggactcccccaagcggctggccaccgccatcgccggcgcctgggagaacggggtgtgcggcatccgcagcaccacccgcatggagaacctcctgtggaagcagatcgcgaacgagctgaactacatcctctgggagaacaacatcaagctgacggtcgtggtgggggacatcatcggcgtcctggagcagggcaagcggaccctcacgccccagccgatggagctgaagtactcctggaagacctgggggaaggccaagatcgtgacggccgagacccagaacagctccttcatcatcgacggccccaacacccccgagtgccccagcgcctcccgcgcgtggaacgtgtgggaggtcgaggactacgggttcggcgtgttcaccacgaacatctggctgaagctccgggaggtgtacacccagagctgcgaccaccgcctgatgagcgccgccatcaaggacgagcgggccgtccacgccgacatgggctactggatcgagtcccagaagaacgggagctggaagctggagaaggcgtccttcatcgaggtgaagacctgcacctggcccaagagccacaccctctggtccaacggcgtgctggagagcgacatgatcatccccaagtccctggccgggcccatcagccagcacaaccaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgctgttcaccttcgtcctcctgctgtccggccagatcacgtggcgggacatggcccacaccctcatcatgatcggcagcaacgcctccgaccgcatggggatgggcgtgacctacctggccctgatcgccaccttcaagatccagcccttcctcgcgctggggttcttcctgcggaagctcacgagccgcgagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgctccaacacgatcttcaccctgaccgtggcctggcggaccgccacgctcatcctggccggggtcagcctgctcccgctgtgccagtccagctccatgcgcaagaccgactggctgcccatgaccgtggcggccatgggcgtgccgcccctcccgctgttcatcttcagcctgaaggacacccccaagcggcgctcctggcccctcaacgagggggtcatggccgtgggcctggtgagcatcctggcctccagcctcctgcgcaacgacgtccccatggccggcccgctggtggccggcgggctcctgatcgcctgctacgtgatcacggggacctccgccgacctgaccgtcgagaaggccgccgacgtgacctgggaggaggaggcggagcagacgggggtgagccacaacctcatgatcaccgtcgacgacgacgggaccatgcggatcaaggacgacgagaccgagaacatcctgaccgtgctgctcaagacggccctgctgatcgtgtccggcatcttcccctacagcatccccgccaccctcctggtctggcacacctggcagaagcagacccagcgctccggcgtgctgtgggacgtgcccagcccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggcgtccgtgaagaaggacctcatcagctacggcgggggctggcgcctgtccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtcgggctgtacggcaacggggtggtgaccaagaacggcgggtacgtctccggcatcgcccagaccaacgccgagcccgacggccccacgcccgagctcgaggaggagatgttcaagaagcgcaacctgaccatcatggacctgcacccggggagcggcaagacccggaagtacctccccgccatcgtgcgcgaggccatcaagcggcgcctgcggaccctgatcctcgcgcccacgcgcgtggtcgccgccgagatggaggaggccctgaaggggctgcccatccggtaccagaccaccgccaccaagtccgagcacacgggccgcgagatcgtggacctcatgtgccacgcgaccttcaccatgcggctgctgagcccggtgcgcgtccccaactacaacctcatcatcatggacgaggcccacttcaccgaccccgcctccatcgccgcccgggggtacatcagcacgcgcgtgggcatgggcgaggcggccgccatcttcatgaccgccacgccgcccgggaccgcggaggccttcccccagtccaacgcccccatccaggacgaggagcgggacatccccgagcgcagctggaactccggcaacgagtggatcacggacttcgtggggaagaccgtctggttcgtgcccagcatcaaggccggcaacgacatcgccaactgcctgcgcaagaacgggaagaaggtgatccagctgtcccggaagaccttcgacaccgagtaccagaagacgcgcctcaacgactgggacttcgtcgtgaccaccgacatcagcgagatgggcgcgaacttcaaggccgaccgggtgatcgacccccgccggtgcctgaagcccgtcatcctgaccgacggccccgagcgcgtgatcctcgccgggccgatgcccgtgacggccgcctccgcggcccagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagaccttcgtggagctcatgcgccgcggggacctgcccgtctggctggcccacaaggtggccagcgagggcatcaagtacacggaccgcaagtggtgcttcgacggggagcggaacaaccagatcctcgaggagaacatggacgtggagatctggaccaaggagggcgagcgcaagaagctgcggccgcgctggctggacgcgcgcacctactccgaccccctcgccctgaaggagttcaaggacttcgccgccggccgcaagagcatcgccttcgacctggtcaccgagatcgggcgcgtgccctcccacctcgcgtaccggacgcgcaacgccctggacaacctggtgatgctccacaccagcgagcacggcgggcgggcctaccgccacgccgtcgaggagctgccggagaccatggagaccctgctcctgctgggcctcatgatcctgctgaccggcggggccatgctgttcctgatcagcgggaaggggatcggcaagacctccatcgggctgatctgcgtgatcgtgagctccggcatgctctggatggcggacgtccccctgcagtggatcgccagcgccatcgtgctggagttcttcatgatggtgctcctgatccccgagcccgagaagcagcggaccccgcaggacaaccagctggcctacgtcgtgatcgggatcctcaccctggccgcgatcgtggccgccaacgagatgggcctgctcgagacgaccaagcgcgacctgggcatgtccaaggagcccggggtcgtgagccccacctcctacctggacgtggacctccaccccgccagcgcctggaccctgtacgcggtcgccacgaccgtgatcaccccgatgctgcggcacaccatcgagaactccacggccaacgtgagcctcgccgcgatcgccaaccaggccgtcgtgctgatgggcctggacaaggggtggcccatctccaagatggacctcggcgtgcccctgctggccctcgggtgctacagccaggtcaaccccctgaccctgaccgccgcggtgctcctgctggtgacccactacgccatcatcggcccgggcctccaggccaaggccacgcgcgaggcccagaagcggaccgcggccgggatcatgaagaaccccaccgtcgacggcatcatgaccatcgacctggaccccgtgatctacgactccaagttcgagaagcagctgggccaggtgatgctcctggtcctgtgcgccgtgcagctcctgctgatgcgcacgagctgggccctctgcgaggccctgaccctggcgaccggccccatcaccacgctctgggagggctccccggggaagttctggaacaccaccatcgccgtgagcatggccaacatcttccggggctcctacctggccggggcgggcctggccttcagcatcatgaagtccgtcgggatcggccgccggggcaccgggagccagggcgagacgctcggggagaagtggaagaagaagctgaaccagctgagccgcaaggagttcgacctctacaagaagtccggcatcaccgaggtggaccggaccgaggccaaggaggggctgaagcgcggcgagaccacccaccacgccgtgagccggggctccgccaagctgcagtggttcgtcgagcgcaacatggtgatccccgaggggcgggtgatcgacctcggctgcgggcgcggcgggtggagctactactgcgcgggcctgaagaaggtcacggaggtgcgcggctacaccaagggcggccccgggcacgaggagcccgtgccgatgtccacctacggctggaacatcgtcaagctgatgagcgggaaggacgtgttctacctgccgcccgagaagtgcgacaccctgctgtgcgacatcggcgagtccagcccctccccgacggtggaggagagccggaccatccgcgtcctgaagatggtggagccctggctcaagaacaaccagttctgcatcaaggtgctgaacccctacatgcccaccgtcatcgagcacctggagcggctccagcgcaagtacggcgggatgctggtgcggaacccgctgtcccgcaacagcacccacgagatgtactggatctccaacggcacggggaacatcgtgagctccgtcaacatggtgagccggctcctgctgaaccgcttcaccatgacccaccggcgccccaccatcgagaaggacgtcgacctcggcgccggcacgcggcacgtgaacgccgagcccgagaccccgaacatggacgtgatcggggagcgcatcaagcggatcaaggaggagcactccagcacctggcactacgacgacgagaacccctacaagacctgggcctaccacggctcctacgaggtcaaggccacggggagcgcgagctccatgatcaacggcgtggtgaagctgctgaccaagccctgggacgtcgtgcccatggtgacccagatggccatgaccgacacgaccccgttcgggcagcagcgcgtcttcaaggagaaggtggacacccggacgccccggcccatgcccggcacgcggaaggtgatggagatcaccgccgagtggctctggcgcaccctgggccggaacaagaagccgcgcctgtgcacccgcgaggagttcacgaagaaggtccggaccaacgccgccatgggggcggtgttcaccgaggagaaccagtgggacagcgcccgcgccgccgtggaggacgaggagttctggaagctcgtcgaccgggagcgcgagctgcacaagctgggcaagtgcgggtcctgcgtgtacaacatgatgggcaagcgggagaagaagctcggggagttcggcaaggcgaagggcagccgcgccatctggtacatgtggctgggggcccggtacctggagttcgaggccctcggcttcctgaacgaggaccactggttctcccgcgagaacagctactccggggtggagggcgaggggctgcacaagctcggctacatcctgcgggacatcagcaagatccccggcggggccatgtacgcggacgacaccgccggctgggacacgcgcatcaccgaggacgacctgcacaacgaggagaagatcacccagcagatggaccccgagcaccggcagctcgccaacgccatcttcaagctgacctaccagaacaaggtcgtgaaggtgcagcgccccacgccgaaggggaccgtcatggacatcatctcccggaaggaccagcgcggcagcggccaggtggggacctacggcctgaacaccttcaccaacatggaggcccagctcgtgcggcagatggagggggagggcgtcctgtccaaggcggacctggagaacccccacctcctggagaagaagatcacgcagtggctggagaccaagggggtggagcgcctcaagcggatggccatcagcggcgacgactgcgtggtcaagcccatcgacgaccgcttcgccaacgccctgctggccctcaacgacatgggcaaggtgcggaaggacatcccccagtggcagccgtccaaggggtggcacgactggcagcaggtccccttctgcagccaccacttccacgagctgatcatgaaggacggccgcaagctggtcgtgccctgccggccccaggacgagctcatcgggcgcgcgcgcatctcccagggcgccgggtggagcctgaaggagaccgcctgcctgggcaaggcctacgcccagatgtggtccctcatgtacttccaccggcgcgacctgcggctggcgagcaacgccatctgctccgccgtgccggtccactggatccccaccagccgcacgacctggagcatccacgcccaccaccagtggatgaccaccgaggacatgctcacggtgtggaaccgggtgtggatcgaggacaacccctggatggaggacaagacccccgtcaccacctgggaggacgtgccgtacctgggcaagcgcgaggaccagtggtgcgggtccctgatcggcctcacgagccgggcgacctgggcccagaacatcctgaccgccatccagcaggtccgctccctgatcggggacgaggagttcctcgactacatgcccagcatgaagcggttccgcaaggaggaggagtccgagggcgccatctggtga

SEQ ID NO: 10297 - RNA, 9873 nt, synthetic construct
  misc_feature 1..9873: note = derived and/or modified CDS sequence (opt1) from DENV-3__EU482456__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaccgagatgatcctcctgacgatgaagaacaaggcgtggatggtccaccggcagtggttcttcgacctgcccctcccctggaccagcggcgccaccaccgagacgcccacctggaaccgcaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtctccgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacaccatcggcgtcctggagcagggcaagcgcaccctcacgccccagccgatggagctgaagtactcctggaagacctgggggaaggcgaagatcgtgaccgccgagacccagaacagctccttcatcatcgacggccccaacacgcccgagtgccccagcgcctcccgggcctggaacgtgtgggaggtcgaggactacgggttcggcgtgttcaccaccaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacgtggccgaagagccacaccctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcacgaccgtcgtgatcaccgagaactgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcacgatgggcgtcctgtgcctcgccatcctgttcgaggaggtgatgcgggggaagttcggcaagaagcacatgatcgccggggtgctgttcaccttcgtcctcctgctgtccggccagatcacctggcgcgacatggcgcacaccctcatcatgatcggcagcaacgcctccgaccggatggggatgggcgtgacgtacctggccctgatcgccaccttcaagatccagcccttcctcgccctggggttcttcctgcgcaagctcaccagccgggagaacctgctgctcggcgtgggcctggcgatggccaccacgctgcagctccccgaggacatcgagcagatggccaacgggatcgccctgggcctgatgaccctcaagctgatcacccagttcgagacctaccagctgtggacggcgctcgtcagcctgacctgctccaacaccatcttcaccctgacggtggcctggcgcaccgccaccctcatcctggccggggtcagcctgctcccgctgtgccagtccagctccatgcggaagaccgactggctgcccatgacggtggccgcgatgggcgtgccccccctcccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcaccgggacctccgccgacctgacggtcgagaaggccgccgacgtgacctgggaggaggaggccgagcagaccggcgtgagccacaacctcatgatcaccgtcgacgacgacgggaccatgcgcatcaaggacgacgagacggagaacatcctgaccgtgctgctcaagaccgcgctgctgatcgtgtccggcatcttcccctacagcatccccgccaccctcctggtctggcacacgtggcagaagcagacccagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacacgatgtggcacgtgacccggggcgccgtcctgacccacaacgggaagcgcctggagcccaactgggcctccgtgaagaaggacctcatcagctacggcgggggctggcggctgtccgcgcagtggcagaagggggaggaggtgcaggtcatcgccgtggagcccggcaagaacccgaagaacttccagaccatgcccggcatcttccagacgaccaccggggagatcggcgccatcgccctggacttcaagcccgggaccagcggcagcccgatcatcaaccgcgagggcaaggtggtcgggctgtacggcaacggggtggtgacgaagaacggcgggtacgtctccggcatcgcgcagaccaacgccgagcccgacggccccacccccgagctcgaggaggagatgttcaagaagcggaacctgaccatcatggacctgcacccggggagcggcaagacgcgcaagtacctccccgccatcgtgcgggaggccatcaagcgccggctgcgcaccctgatcctcgcccccacccgggtggtcgcggccgagatggaggaggccctgaaggggctgcccatccgctaccagaccacggccaccaagtccgagcacaccggccgggagatcgtggacctcatgtgccacgccaccttcacgatgcgcctgctgagcccggtgcgggtccccaactacaacctcatcatcatggacgaggcgcacttcaccgaccccgcctccatcgccgcccgcgggtacatcagcacccgggtgggcatgggcgaggccgcggccatcttcatgaccgccacgcccccggggaccgccgaggcgttcccccagtccaacgcccccatccaggacgaggagcgcgacatccccgagcgcagctggaactccggcaacgagtggatcaccgacttcgtggggaagaccgtctggttcgtgccgagcatcaaggccggcaacgacatcgccaactgcctgcggaagaacgggaagaaggtgatccagctgtcccgcaagacgttcgacaccgagtaccagaagacccggctcaacgactgggacttcgtcgtgaccacggacatcagcgagatgggcgccaacttcaaggcggaccgcgtgatcgacccccggcgctgcctgaagcccgtcatcctgaccgacggccccgagcgggtgatcctcgccgggccgatgcccgtgaccgccgcctccgccgcgcagcgccggggccgcgtcgggcggaacccccagaaggagaacgaccagtacatcttcaccggccagcccctgaacaacgacgaggaccacgcccactggaccgaggccaagatgctgctcgacaacatcaacacgccggaggggatcatccccgccctgttcgagcccgagcgcgagaagagcgccgcgatcgacggcgagtaccggctgaagggcgagtcccgcaagaccttcgtggagctcatgcggcgcggggacctgcccgtctggctggcccacaaggtggccagcgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcccggacgtactccgaccccctcgcgctgaaggagttcaaggacttcgccgccggccgcaagagcatcgccctggacctcgtcaccgagatcgggcgggtgccctcccacctggcctaccgcacccggaacgcgctggacaacctcgtgatgctgcacaccagcgagcacggcgggcgcgcctaccggcacgccgtcgaggagctgccggagacgatggagaccctcctgctgctcggcctgatgatcctgctcaccgggggcgccatgctgttcctgatcagcggcaaggggatcggcaagacctccatcgggctcatctgcgtgatcgtgagctccggcatgctgtggatggccgacgtccccctgcagtggatcgcgagcgccatcgtgctcgagttcttcatgatggtgctgctgatccccgagcccgagaagcagcgcacgccgcaggacaaccagctcgcctacgtcgtgatcgggatcctgaccctggccgccatcgtggcggccaacgagatgggcctcctggagaccaccaagcgggacctgggcatgtccaaggagcccggggtcgtgagccccacgtcctacctcgacgtggacctgcaccccgccagcgcctggaccctgtacgccgtcgcgaccaccgtgatcacgccgatgctccgccacaccatcgagaactccaccgccaacgtgagcctggccgccatcgcgaaccaggccgtcgtgctgatgggcctcgacaaggggtggcccatctccaagatggacctgggcgtgcccctgctcgccctggggtgctacagccaggtcaaccccctgaccctcacggccgccgtgctgctgctcgtgacccactacgcgatcatcggcccgggcctgcaggccaaggccacccgggaggcccagaagcgcaccgccgcggggatcatgaagaaccccacggtcgacggcatcatgaccatcgacctggaccccgtgatctacgactccaagttcgagaagcagctcgggcaggtgatgctgctggtcctctgcgccgtgcagctgctgctcatgcggaccagctgggccctgtgcgaggccctgaccctcgccacgggccccatcaccaccctgtgggagggctccccggggaagttctggaacaccacgatcgcggtgagcatggccaacatcttccgcggctcctacctggccggggccggcctcgcgttcagcatcatgaagtccgtcgggaccggccggcgcggcaccgggagccagggcgagaccctgggggagaagtggaagaagaagctgaaccagctcagccggaaggagttcgacctgtacaagaagtccggcatcaccgaggtggaccgcacggaggccaaggaggggctgaagcggggcgagaccacccaccacgccgtgagccgcggctccgccaagctccagtggttcgtcgagcggaacatggtgatccccgaggggcgcgtgatcgacctgggctgcgggcgcggcgggtggagctactactgcgccggcctgaagaaggtcaccgaggtgcggggctacacgaaggggggccccgggcacgaggagcccgtgccgatgtccacctacggctggaacatcgtcaagctcatgagcgggaaggacgtgttctacctgccccccgagaagtgcgacaccctgctgtgcgacatcggcgagtccagcccctccccgaccgtggaggagagccgcacgatccgggtcctcaagatggtggagccctggctgaagaacaaccagttctgcatcaaggtgctgaacccctacatgcccaccgtcatcgagcacctcgagcgcctgcagcggaagtacggcgggatgctggtgcgcaacccgctctcccggaacagcacccacgagatgtactggatctccaacggcaccgggaacatcgtgagctccgtcaacatggtgagccgcctgctgctcaaccggttcacgatgacccaccgccggcccaccatcgagaaggacgtcgacctgggcgcgggcacccgccacgtgaacgccgagcccgagacgccgaacatggacgtgatcggggagcggatcaagcgcatcaaggaggagcactccagcacctggcactacgacgacgagaacccctacaagacctgggcctaccacggctcctacgaggtcaaggccaccgggagcgccagctccatgatcaacggcgtggtgaagctgctcacgaagccctgggacgtcgtgcccatggtgacccagatggcgatgaccgacaccacgccgttcgggcagcagcgggtcttcaaggagaaggtggacacccgcaccccccggcccatgcccggcacccgcaaggtgatggagatcacggccgagtggctgtggcggaccctgggccgcaacaagaagccgcgcctctgcacccgggaggagttcaccaagaaggtccgcacgaacgccgccatgggggccgtgttcaccgaggagaaccagtgggacagcgcgcgggccgccgtggaggacgaggagttctggaagctggtcgaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgccgacgacaccgcgggctgggacacccggatcacggaggacgacctccacaacgaggagaagatcacccagcagatggaccccgagcaccgccagctggccaacgccatcttcaagctgacctaccagaacaaggtcgtgaaggtgcagcggcccaccccgaaggggaccgtcatggacatcatctcccgcaaggaccagcggggcagcggccaggtggggacgtacggcctcaacaccttcaccaacatggaggcccagctggtgcgccagatggagggggagggcgtcctgtccaaggccgacctcgagaacccccacctgctggagaagaagatcacccagtggctcgagacgaagggggtggagcggctgaagcgcatggcgatcagcggcgacgactgcgtggtcaagcccatcgacgaccggttcgccaacgccctgctcgccctgaacgacatgggcaaggtgcgcaaggacatcccccagtggcagccgtccaaggggtggcacgactggcagcaggtgcccttctgcagccaccacttccacgagctgatcatgaaggacggccggaagctcgtcgtgccctgccgcccccaggacgagctgatcgggcgcgcccggatctcccagggcgcggggtggagcctgaaggagaccgcctgcctcggcaaggcctacgcccagatgtggtccctgatgtacttccaccgccgggacctgcgcctcgccagcaacgcgatctgctccgccgtgccggtccactggatccccaccagccggaccacgtggagcatccacgcccaccaccagtggatgaccaccgaggacatgctgaccgtgtggaaccgcgtgtggatcgaggacaacccctggatggaggacaagacgcccgtcaccacctgggaggacgtgccgtacctgggcaagcgggaggaccagtggtgcgggtccctcatcggcctgaccagccgcgccacgtgggcgcagaacatcctgaccgccatccagcaggtgcggtccctcatcggggacgaggagttcctggactacatgcccagcatgaagcgcttccggaaggaggaggagtccgagggcgccatctggtga

SEQ ID NO: 10298 - RNA, 9873 nt, synthetic construct
  misc_feature 1..9873: note = derived and/or modified CDS sequence (opt1) from DENV-3__EU482457__SS-prME
  source 1..9873: mol_type = other RNA
accagcttctgcctcatgatgatgctccccgccaccctggccttccacctgaccagccgggacggcgagccgcggatgatcgtggggaagaacgagcggggcaagagcctcctgttcaagaccgcgtccgggatcaacatgtgcaccctgatcgccatggacctcggcgagatgtgcgacgacaccgtcacctacaagtgccccctgatcgccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacctgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgacacccagggggtgacggtcgagatcacgccccaggccagcaccgtggaggccgtgctgcccgagtacggcatcctggggctcgagtgctccccgcgcaccggcctggacttcaacgagatgatcctgctcaccatgaagaacaaggcgtggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgccatgcacaccgcgctcaccggggccacggagatccagaacagcggcgggacctccatcttcgccggccacctgaagtgccggctgaagatggaccgcctcgagctgaagggcatgagctacgccatgtgcctgaacaccttcgtgctcaagaaggaggtctccgagacccagcacgggacgatcctgatcaaggtggagtacaagggcgaggacgccccgtgcaagatccccttcagcaccgaggacgggcagggcaaggcgcacaacggccggctgatcaccgccaaccccgtggtcaccaagaaggaggagcccgtgaacatcgaggccgagccgcccttcggggagagcaacatcgtgatcggcatcggggacaaggccctgaagatcaactggtacaagaagggctccagcatcgggaagatgttcgaggcgacggcccgcggcgcccggcgcatggccatcctcggcgacaccgcctgggacttcgggtccgtcggcggggtgctgaacagcctgggcaagatggtgcaccagatcttcgggtccgcgtacaccgccctcttcagcggcgtctcctggatcatgaagatcggcatcggggtgctgctgacctggatcggcctcaacagcaagaacacgtccatgagcttctcctgcatcgtgatcgggatcatcaccctgtacctgggcgccgtcgtgcaggccgacatggggtgcgtgatcaactggaagggcaaggagctcaagtgcggcagcgggatcttcgtcaccaacgaggtgcacacctggacggagcagtacaagttccaggccgactcccccaagcgcctggcgaccgccatcgccggcgcctgggagaacggggtgtgcggcatccggagcaccacccgcatggagaacctgctctggaagcagatcgccaacgagctgaactacatcctgtgggagaacaacatcaagctcacggtcgtggtgggggacaccatcggcgtcctggagcagggcaagcggaccctgacgccccagccgatggagctcaagtactcctggaagacgtgggggaaggcgaagatcgtgaccgccgagacccagaacagctccttcatcatcgacggccccaacacccccgagtgccccagcgcctcccgcgcctggaacgtgtgggaggtcgaggactacgggttcggcgtgttcacgaccaacatctggctgaagctgcgggaggtgtacacccagagctgcgaccaccgcctcatgagcgcggccatcaaggacgagcgggccgtccacgccgacatgggctactggatcgagtcccagaagaacgggagctggaagctggagaaggcctccttcatcgaggtgaagacctgcacctggcccaagagccacacgctgtggtccaacggcgtgctcgagagcgacatgatcatccccaagtccctggcggggcccatcagccagcacaaccaccgcccgggctaccacacccagaccgccgggccctggcacctgggcaagctcgagctggacttcaactactgcgagggcaccacggtcgtgatcaccgagaactgcgggacccggggcccctccctgcgcaccacgaccgtgagcgggaagctcatccacgagtggtgctgccggtcctgcaccctgcccccgctgcgctacatgggcgaggacgggtgctggtacggcatggagatccggcccatcaacgagaaggaggagaacatggtcaagagcctcgtgtccgccggcagcgggaaggtggacaacttcaccatgggcgtcctgtgcctggccatcctcttcgaggaggtgatgcgcgggaagttcggcaagaagcacatgatcgccggggtgctgttcacgttcgtcctgctcctgtccggccagatcacctggcgggacatggcgcacaccctgatcatgatcggcagcaacgcctccgaccgcatggggatgggcgtgacctacctcgccctgatcgccacgttcaagatccagcccttcctggccctcgggttcttcctgcggaagctgaccagccgcgagaacctcctgctgggcgtgggcctcgcgatggccaccaccctgcagctgcccgaggacatcgagcagatggccaacgggatcgccctcggcctgatgacgctgaagctcatcacccagttcgagacctaccagctgtggaccgcgctggtcagcctcacgtgctccaacaccatcttcaccctgaccgtggcctggcggacggccaccctgatcctcgccggggtcagcctgctgccgctctgccagtccagctccatgcgcaagaccgactggctgcccatgaccgtggccgcgatgggcgtgccgcccctccccctcttcatcttcagcctgaaggacacgcccaagcgccggtcctggcccctgaacgagggggtcatggccgtgggcctcgtgagcatcctggcctccagcctgctccgcaacgacgtccccatggccggcccgctggtggccgggggcctgctcatcgcgtgctacgtgatcaccgggacctccgccgacctgaccgtcgagaaggccgccgacgtgacgtgggaggaggaggccgagcagaccggcgtgagccacaacctgatggtcaccgtggacgacgacgggaccatgcggatcaaggacgacgagaccgagaacatcctcacggtgctgctgaagaccgcgctcctgatcgtctccggcatcttcccctacagcatccccgccaccctgctcgtgtggcacacctggcagaagcagacgcagcgctccggcgtgctgtgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgccgtgctcacccacaacgggaagcggctggagcccaactgggcctccgtgaagaaggacctgatcagctacggcgggggctggcgcctctccgcgcagtggcagaagggggaggaggtccaggtgatcgccgtggagcccggcaagaacccgaagaacttccagaccatgcccggcatcttccagaccacgaccggggagatcggcgccatcgccctggacttcaagcccgggaccagcggcagcccgatcatcaaccgggagggcaaggtcgtggggctgtacggcaacggggtggtcaccaagaacggcgggtacgtgtccggcatcgcgcagacgaacgccgagcccgacggccccacccccgagctggaggaggagatgttcaagaagcgcaacctcaccatcatggacctgcacccggggagcggcaagacccggaagtacctgcccgccatcgtgcgcgaggccatcaagcggcgcctccggacgctgatcctggcccccacccgcgtcgtggcggccgagatggaggaggccctcaaggggctgcccatccggtaccagaccaccgccacgaagtccgagcacaccggccgcgagatcgtggacctgatgtgccacgccaccttcaccatgcggctcctgagcccggtccgcgtgcccaactacaacctgatcatcatggacgaggcgcacttcacggaccccgcctccatcgccgcccgggggtacatcagcacccgcgtgggcatgggcgaggccgcggccatcttcatgaccgccacgcccccggggacggccgaggcgttcccccagtccaacgcccccatccaggacgaggagcgcgacatccccgagcggagctggaactccggcaacgagtggatcaccgacttcgtcgggaagaccgtgtggttcgtgccgagcatcaaggccggcaacgacatcgccaactgcctccgcaagaacgggaagaaggtcatccagctgtcccggaagaccttcgacacggagtaccagaagacccgcctgaacgactgggacttcgtggtgaccaccgacatcagcgagatgggcgccaacttcaaggcggaccgggtcatcgacccccgccggtgcctcaagcccgtgatcctgacggacggccccgagcgcgtgatcctggccgggccgatgcccgtcaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacaccccggaggggatcatccccgccctcttcggccccgagcgggagaagtccgccgcgatcgacggcgagtaccgcctgaagggggagtcccggaagacgttcgtcgagctgatgcgccggggcgacctccccgtgtggctggcctacaaggtggccagcgaggggatcaagtacaccgaccgcaagtggtgcttcgacggcgagcggaacaaccagatcctggaggagaacatggacgtcgagatctggaccaaggagggcgagcgcaagaagctccgcccgcggtggctggacgcccgcacctactccgaccccctggcgctcaaggagttcaaggacttcgccgccgggcgcaagagcatcgccctggacctggtgacggagatcggccgcgtgccctcccacctcgcccaccggacccgcaacgcgctggacaacctggtcatgctccacaccagcgagcacgggggccgggcctaccgccacgccgtggaggagctgccggagaccatggagacgctgctcctgctggggctcatgatcctgctgaccggcggcgccatgctgttcctgatcagcgggaagggcatcgggaagacctccatcggcctgatctgcgtgatcgtcagctccgggatgctctggatggccgacgtgcccctgcagtggatcgcgagcgccatcgtgctggagttcttcatgatggtcctcctgatccccgagcccgagaagcagcggaccccgcaggacaaccagctggcctacgtggtgatcggcatcctcacgctggccgccatcgtcgcggccaacgagatgggcctgctcgagaccaccaagcgcgacctggggatgtccaaggagcccggcgtggtgagccccacctcctacctggacgtcgacctccaccccgccagcgcctggacgctgtacgccgtggcgaccaccgtgatcaccccgatgctgcggcacacgatcgagaactccaccgccaacgtcagcctcgccgccatcgcgaaccaggccgtggtgctgatggggctggacaagggctggcccatctccaagatggacctcggggtccccctgctggccctcggctgctacagccaggtgaaccccctgaccctgaccgccgccgtgctcctgctggtcacgcactacgcgatcatcggcccggggctccaggccaaggccacccgcgaggcccagaagcggaccgccgcgggcatcatgaagaaccccaccgtggacgggatcatgacgatcgacctggaccccgtgatctacgactccaagttcgagaagcagctgggccaggtcatgctcctggtgctgtgcgccgtgcagctcctgctgatgcgcaccagctgggccctctgcgaggccctgaccctggccaccggccccatcacgaccctctgggaggggtccccgggcaagttctggaacaccaccatcgcggtcagcatggccaacatcttccgggggtcctacctggccggcgccgggctggcgttcagcatcatgaagtccgtgggcacgggccgccgggggaccggcagccagggggagaccctcggcgagaagtggaagaagaagctgaaccagctgagccgcaaggagttcgacctctacaagaagtccgggatcaccgaggtggaccggaccgaggccaaggagggcctgaagcgcggcgagacgacccaccacgccgtcagccgggggtccgccaagctgcagtggttcgtggagcgcaacatggtgatccccgagggccgcgtcatcgacctcgggtgcggccgcggcgggtggagctactactgcgccgggctgaagaaggtgaccgaggtgcgcgggtacaccaagggcgggcccggccacgaggagcccgtcccgatgtccacgtacgggtggaacatcgtgaagctgatgagcggcaaggacgtgttctacctgccgcccgagaagtgcgacaccctgctgtgcgacatcggcgagtccagcccctccccgaccgtcgaggagagccggaccatccgcgtgctgaagatggtggagccctggctcaagaacaaccagttctgcatcaaggtcctgaacccctacatgcccacggtgatcgagcacctggagcggctccagcgcaagtacgggggcatgctggtgcggaacccgctgtcccgcaacagcacccacgagatgtactggatctccaacgggaccggcaacatcgtcagctccgtgaacatggtcagccggctcctgctgaaccgcttcaccatgacgcaccggcgccccaccatcgagaaggacgtggacctcggcgcggggacccggcacgtgaacgccgagcccgagaccccgaacatggacgtcatcggcgagcgcatcaagcggatcaaggaggagcactccagcacgtggcactacgacgacgagaacccctacaagacctgggcctaccacgggtcctacgaggtgaaggccaccggcagcgccagctccatgatcaacggggtggtcaagctgctgaccaagccctgggacgtggtgcccatggtcacgcagatggcgatgaccgacaccaccccgttcggccagcagcgcgtgttcaaggagaaggtggacacgcggacgccccggcccatgcccggcacccggaaggtcatggagatcaccgccgagtggctctggcgcacgctggggcgcaacaagaagccgcggctgtgcacccgcgaggagttcaccaagaaggtgcggaccaacgccgccatgggcgccgtgttcacggaggagaaccagtgggacaacgcgcgcgccgccgtcgaggacgaggagttctggaagctcgtggaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgagaactcctacagcggcgtcgagggggagggcctgcacaagctcggctacatcctgcgggacatctccaagatccccgggggcgccatgtacgccgacgacaccgcggggtgggacacccgcatcaccgaggacgacctgcacaacgaggagaagatcacgcagcagatggaccccgagcaccggcagctcgccaacgccatcttcaagctgacctaccagaacaaggtggtgaaggtccagcgccccaccccgaagggcaccgtgatggacatcatcagccggaaggaccagcgcggctccggccaggtgggcacctacgggctgaacacgttcaccaacatggaggcccagctcgtccggcagatggagggcgagggggtgctgagcaaggccgacctggagaacccccacctcctggagaagaagatcacccagtggctggagaccaagggcgtggagcgcctcaagcggatggcgatctccggcgacgactgcgtcgtgaagcccatcgacgaccgcttcgccaacgccctgctggccctcaacgacatggggaaggtgcggaaggacatcccccagtggcagccgagcaagggctggcacgactggcagcaggtccccttctgctcccaccacttccacgagctgatcatgaaggacgggcgcaagctggtggtgccctgccgcccccaggacgagctcatcggccgggcccgcatcagccagggggcgggctggtccctgaaggagacggcctgcctgggcaaggcctacgcccagatgtggagcctcatgtacttccaccggcgcgacctgcggctggcctccaacgcgatctgcagcgccgtcccggtgcactggatccccacctcccgcaccacctggagcatccacgcccaccaccagtggatgacgaccgaggacatgctcaccgtgtggaaccgggtctggatcgaggacaacccctggatggaggacaagacccccgtgacgacctgggaggacgtgccgtacctggggaagcgcgaggaccagtggtgcggcagcctgatcgggctcacctcccgggccacctgggcgcagaacatcctgacggccatccagcaggtccgcagcctgatcggcgacgaggagttcctcgactacatgccctccatgaagcggttccgcaaggaggaggagagcgagggggccatctggtga

SEQ ID NO: 10299 - RNA, 9873 nt, synthetic construct
  misc_feature 1..9873: note = derived and/or modified CDS sequence (opt1) from DENV-3__EU482458__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctgaccaccttcaagaacgcccacgccaagaagcaggaggtggtggtcctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtgtccgagacgcagcacgggaccatcctgatcaaggtcgagtacaagggcgaggacgccccgtgcaagatccccttcagcaccgaggacgggcagggcaaggcgcacaacggccgcctgatcaccgccaaccccgtggtgacgaagaaggaggagcccgtcaacatcgaggccgagccgcccttcggggagagcaacatcgtgatcggcatcggggacaaggccctcaagatcaactggtacaagaagggctccagcatcgggaagatgttcgaggcgaccgcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacgtggatcggcctgaacagcaagaacacctccatgagcttctcctgcatcgtgatcgggatcatcaccctgtacctcggcgccgtggtccaggccgacatggggtgcgccatcaactggaagggcaaggagctgaagtgcggcagcgggatcttcgtgaccaacgaggtgcacacgtggaccgagcagtacaagttccaggcggactcccccaagcgcctggccaccgccatcgccggcgcctgggagaacggggtctgcggcatccgcagcaccacgcggatggagaacctcctgtggaagcagatcgcgaacgagctgaactacatcctctgggagaacaacatcaagctgaccgtggtggtcggggacatcatcggcgtgctggagcagggcaagcgcaccctcacgccccagccgatggagctgaagtactcctggaagacgtgggggaaggccaagatcgtgaccgccgagacccagaacagctccttcatcatcgacggccccaacacccccgagtgccccagcgcctcccgggcgtggaacgtctgggaggtggaggactacgggttcggcgtgttcacgaccaacatctggctgaagctccgcgaggtctacacccagagctgcgaccaccggctgatgagcgccgccatcaaggacgagcgcgccgtgcacgccgacatgggctactggatcgagtcccagaagaacgggagctggaagctggagaaggcgtccttcatcgaggtgaagacctgcacctggcccaagagccacacgctctggtccaacggcgtcctggagagcgacatgatcatccccaagtccctggccgggcccatcagccagcacaaccaccggccgggctaccacacccagaccgccgggccctggcacctcggcaagctggagctggacttcaactactgcgagggcaccacggtggtgatcaccgagaactgcgggatgcgcggcccctccctccggaccaccacggtcagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcctgttcaccttcgtgctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtcggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgccgctcctggcccctcaacgagggggtgatggccgtgggcctggtcagcatcctggcctccagcctcctgcggaacgacgtgcccatggccggcccgctggtggccggcgggctcctgatcgcctgctacgtcatcacggggacctccgccgacctgaccgtggagaaggccgccgacgtgacctgggaggaggaggcggagcagacgggggtcagccacaacctcatgatcaccgtggacgacgacgggaccatgcgcatcaaggacgacgagaccgagaacatcctgaccgtgctgctcaagacggccctgctgatcgtctccggcatcttcccctacagcatccccgccaccctcctggtgtggcacacctggcagaagcagacccagcggtccggcgtgctgtgggacgtccccagcccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggcgtccgtgaagaaggacctcatcagctacggcgggggctggcggctgtccgcccagtggcagaagggggaggaggtccaggtgatcgccgtggagcccggcaagaacccgaagaacttccagaccatgcccggcatcttccagaccaccacgggggagatcggcgccatcgcgctggacttcaagcccgggaccagcggcagcccgatcatcaaccgcgagggcaaggtcgtggggctgtacggcaacggggtggtcaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcgcccacgcgggtcgtggccgccgagatggaggaggccctgaaggggctgcccatccgctaccagaccaccgccaccaagtccgagcacacgggccgggagatcgtggacctcatgtgccacgcgaccttcaccatgcgcctgctgagcccggtccgggtgcccaactacaacctcatcatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgcgaacttcaaggccgaccgcgtcatcgacccccggcgctgcctgaagcccgtgatcctgaccgacggccccgagcgggtgatcctcgccgggccgatgcccgtcacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtggagctcatgcggcgcggggacctgcccgtctggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgtaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacctacggctggaacatcgtgaagctcatgagcgggaaggacgtgttctacctgccgcccgagaagtgcgacacgctgctgtgcgacatcggcgagtccagcccctccccgaccgtcgaggagagccgcaccatccgggtgctcaagatggtggagccctggctgaagaacaaccagttctgcatcaaggtcctgaacccctacatgcccaccgtgatcgagcacctcgagcgcctgcagcggaagtacggcgggatgctggtgcgcaacccgctctcccggaacagcacgcacgagatgtactggatctccaacggcaccgggaacatcgtcagctccgtgaacatggtgagccgcctgctgctcaaccggttcaccatgacccaccgccggcccacgatcgagaaggacgtcgacctgggcgccggcacccgccacgtgaacgccgagcccgagaccccgaacatggacgtcatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtggtcaagctgctcaccaagccctgggacgtggtgcccatggtcacccagatggccatgacggacaccaccccgttcgggcagcagcgggtgttcaaggagaaggtggacacccgcacgccccggcccatgcccggcacccgcaaggtcatggagatcaccgccgagtggctgtggcggaccctgggccgcaacaagaagccgcgcctctgcacgcgggaggagttcaccaagaaggtgcgcaccaacgccgccatgggggcggtgttcaccgaggagaaccagtgggacagcgcccgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgcggacgacacggccggctgggacacccggatcaccgaggacgacctccacaacgaggagaagatcacccagcagatggaccccgagcaccgccagctggccaacgccatcttcaagctgacgtaccagaacaaggtggtgaaggtccagcggcccaccccgaaggggaccgtgatggacatcatctcccgcaaggaccagcggggcagcggccaggtggggacctacggcctcaacaccttcacgaacatggaggcccagctggtccgccagatggagggggagggcgtgctgtccaaggcggacctcgagaacccccacctcctggagaagaagatcacccagtggctcgagaccaagggggtggagcggctgaagcgcatggccatcagcggcgacgactgcgtcgtgaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtggtgccctgccgcccccaggacgagctgatcgggcgcgcgcggatctcccagggcgccgggtggagcctgaaggagaccgcctgcctcggcaaggcctacgcccagatgtggtccctgatgtacttccaccgccgggacctgcgcctcgcgagcaacgccatctgctccgccgtcccggtgcactggatccccacgagccggaccacctggagcatccacgcccaccaccagtggatgaccacggaggacatgctgaccgtgtggaaccgcgtctggatcgaggacaacccctggatggaggacaagacccccatcaccacgtgggaggacgtgccgtacctgggcaagcgggaggaccagtggtgcgggtccctcatcggcctgaccagccgcgcgacctgggcccagaacatcctgaccgccatccagcaggtccggtccctcatcggggacgaggagttcctggactacatgcccagcatgaagcgcttccggaaggaggaggagtccgagggcgccatctggtga

SEQ ID NO: 10300 - RNA, 9873 nt, synthetic construct
  misc_feature 1..9873: note = derived and/or modified CDS sequence (opt1) from DENV-3__EU482459__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtgacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccggtgcgggtgcccaactacaacctcatcatcatggacgaggcccacttcaccgaccccgcctccatcgccgcccgcgggtacatcagcacgcgggtcggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtggggaagaccgtgtggttcgtccccagcatcaaggccggcaacgacatcgccaactgcctgcggaagaacgggaagaaggtgatccagctgtcccgcaagaccttcgacaccgagtaccagaagacgcggctcaacgactgggacttcgtggtcaccaccgacatcagcgagatgggcgcgaacttcaaggccgaccgcgtgatcgacccccggcgctgcctgaagcccgtgatcctgaccgacggccccgagcgggtcatcctcgccgggccgatgcccgtgacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgtaccgcacgcggaacgccctggacaacctcgtgatgctgcacaccagcgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtcatcgtgagctccggcatgctgtggatggcggacgtgcccctgcagtggatcgccagcgccatcgtcctcgagttcttcatgatggtgctgctgatccccgagcccgagaagcagcgcaccccgcaggacaaccagctcgcctacgtggtcatcgggatcctgaccctggccgcgatcgtggccgccaacgagatgggcctcctggagacgaccaagcgggacctgggcatgtccaaggagcccggggtggtcagccccacctcctacctcgacgtggacctgcaccccgccagcgcctggaccctgtacgcggtggccacgaccgtcatcaccccgatgctccgccacaccatcgagaactccacggccaacgtgagcctggccgcgatcgccaaccaggccgtggtcctgatgggcctcgacaaggggtggcccatctccaagatggacctgggcgtgcccctgctcgccctggggtgctacagccaggtgaaccccctgaccctcaccgccgcggtcctgctgctcgtgacccactacgccatcatcggcccgggcctgcaggccaaggccacgcgggaggcccagaagcgcaccgcggccgggatcatgaagaaccccaccgtggacggcatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgcgaccggccccatcaccacgctgtgggagggctccccggggaagttctggaacaccaccatcgccgtgagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtcgaccgcaccgaggccaaggaggggctgaagcggggcgagaccacgcaccacgccgtgagccgcggctccgccaagctccagtggttcgtggagcggaacatggtcatccccgaggggcgcgtgatcgacctgggctgcgggcgcggcgggtggagctactactgcgcgggcctgaagaaggtgaccgaggtccggggctacaccaagggcggccccgggcacgaggagcccgtgccgatgtccacctacggctggaacctcgtgaagctgatgagcgggaaggacgtcttctacctgccgcccgagaagtgcgacacgctgctctgcgacatcggcgagtccagcccctccccgaccgtggaggagagccgcaccatccgggtgctgaagatggtcgagccctggctgaagaacaaccagttctgcatcaaggtgctcaacccctacatgcccaccgtgatcgagcacctggagcgcctgcagcggaagtacggcgggatgctcgtccgcaacccgctgtcccggaacagcacgcacgagatgtactggatctccaacggcaccgggaacatcgtgagctccgtgaacatggtcagccgcctgctcctgaaccggttcaccatgacccaccgccggcccacgatcgagaaggacgtggacctgggcgccggcacccgccacgtcaacgccgagcccgagaccccgaacatggacgtgatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtcgtgaagctcctgaccaagccctgggacgtggtccccatggtgacccagatggccatgacggacaccaccccgttcgggcagcagcgggtgttcaaggagaaggtcgacacccgcacgccccggcccatgcccggcacccgcaaggtgatggagatcaccgccgagtggctgtggcggaccctcggccgcaacaagaagccgcgcctgtgcacgcgggaggagttcaccaagaaggtgcgcaccaacgccgccatgggggcggtcttcaccgaggagaaccagtgggacagcgcccgggccgccgtggaggacgaggagttctggaagctggtggaccgcgagcgggagctccacaagctgggcaagtgcgggtcctgcgtctacaacatgatgggcaagcgcgagaagaagctgggggagttcggcaaggcgaagggcagccgggccatctggtacatgtggctcggggcccgctacctggagttcgaggccctgggcttcctcaacgaggaccactggttctcccgggagaacagctactccggggtggagggcgaggggctgcacaagctgggctacatcctccgcgacatcagcaagatccccggcggggccatgtacgcggacgacacggccggctgggacacccggatcaccgaggacgacctgcacaacgaggagaagatcacccagcagatggaccccgagcaccgccagctggccaacgccatcttcaagctcacgtaccagaacaaggtggtcaaggtgcagcggcccaccccgaaggggaccgtgatggacatcatctcccgcaaggaccagcggggcagcggccaggtcgggacctacggcctgaacaccttcacgaacatggaggcccagctggtgcgccagatggagggggagggcgtgctctccaaggcggacctggagaacccccacctcctcgagaagaagatcacccagtggctggagaccaagggggtcgagcggctgaagcgcatggccatcagcggcgacgactgcgtggtgaagcccatcgacgaccggttcgccaacgccctcctggccctgaacgacatgggcaaggtccgcaaggacatcccccagtggcagccgtccaaggggtggcacgactggcagcaggtccccttctgcagccaccacttccacgagctcatcatgaaggacggccggaagctggtggtcccctgccgcccccaggacgagctgatcgggcgcgcgcggatctcccagggcgccgggtggagcctcaaggagaccgcctgcctgggcaaggcctacgcccagatgtggtccctgatgtacttccaccgccgggacctccgcctggcgagcaacgccatctgctccgccgtgccggtgcactggatccccacgagccggaccacctggagcatccacgcccaccaccagtggatgaccacggaggacatgctgaccgtctggaaccgcgtgtggatcgaggacaacccctggatggaggacaagacccccgtgaccacgtgggaggacgtcccgtacctcggcaagcgggaggaccagtggtgcgggtccctgatcggcctgaccagccgcgcgacctgggcccagaacatcctcaccgccatccagcaggtccggtccctgatcggggacgaggagttcctggactacatgcccagcatgaagcgcttccggaaggaggaggagtccgagggcgccatctggtga

SEQ ID NO: 10301 - RNA, 9873 nt, synthetic construct
  misc_feature 1..9873: note = derived and/or modified CDS sequence (opt1) from DENV-3__EU482460__SS-prME
  source 1..9873: mol_type = other RNA
accagcctgtgcctcatgatgatgctgcccgccaccttcgccttccacctgacgtcccgcgacggcgagccgcggatgatcgtggggaagaacgagcgcggcaagagcctcctgttcaagaccgcgtccgggatcaacatgtgcaccctgatcgccatggacctcggcgagatgtgcgacgacaccgtcacgtacaagtgccccctgatcgccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccatcctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgacacccagggggtgaccgtcgagatcacgccccaggccagcaccgtggaggccgtgctgcccgagtacggcaccctggggctcgagtgctccccgcgcaccggcctggacttcaacgagatgatcctgctcaccatgaagaacaaggcgtggatggtccaccggcagtggttcttcgacctgcccctgccctggacgagcggcaccaccaccgagacgcccacctggaaccgcaaggagctcctggtgaccttcaagaacgcccacgccaagaagcaggaggtggtcgtgctggggtcccaggagggcgccatgcacaccgccctcacgggggcgaccgagatccagaacagcggcgggacctccatcttcgccggccacctgaagtgccggctgaagatggacaagctcgagctgaagggcatgagctacgccatgtgcctgaacaccttcgtgctcaagaaggaggtctccgagacgcagcacgggaccatcctgatcaaggtggagtacaagggcgaggacgccccgtgcaagatccccttcagcaccgaggacgggcagggcaaggcccacaacggccgcctgatcaccgcgaaccccgtggtcacgaagaaggaggagcccgtgaacatcgaggccgagccgcccttcggggagagcaacatcgtgatcggcatcggggacaaggccctgaagatcaactggtacaagaagggctccagcatcgggaagatgttcgaggccaccgcgcggggcgcccgccggatggccatcctcggcgacaccgcctgggacttcgggtccgtcggcggggtgctgaacagcctgggcaagatggtgcaccagatcttcgggtccgcctacaccgcgctcttcagcggcgtctcctggatcatgaagatcggcatcggggtgctgctgacgtggatcggcctcaacagcaagaacacctccatgagcttctcctgcatcgtgatcgggatcatcaccctgtacctgggcgccgtcgtgcaggccgacatggggtgcgccatcaactggaagggcaaggagctcaagtgcggcagcgggatcttcgtgaccaacgaggtccacacgtggaccgagcagtaccgcttccaggccgactcccccaagcgcctggcgaccgccatcgccggcgcctgggagaacggggtgtgcggcatccggagcaccacgcgcatggagaacctgctctggaagcagatcgccaacgagctgaactacatcctgtgggagaacaacatcaagctcaccgtggtcgtgggggacatcatcggcgtgctggagcagggcaagcgggcgctggccccccagccgatggagctcaagtactcctggaagacctgggggaaggccaagatcgtcaccgccgagacgcagaacagctccttcatcatcgacggccccaacacccccgagtgccccagcgcgtcccgcgcctggaacgtgtgggaggtggaggactacgggttcggcgtcttcaccaccaacatctggctgaagctgcgggaggtgtacacgcagagctgcgaccaccgcctcatgagcgccgccatcaaggacgagcgggccgtgcacgcggacatgggctactggatcgagtcccagaagaacgggagctggaagctggagaaggcctccttcatcgaggtcaagacctgcacctggccgaagagccacaccctgtggtccaacggcgtgctcgagagcgacatgatcatccccaagtccctggccgggcccatcagccagcacaaccaccgcccgggctaccacacccagacggccgggccctggcacctgggcaagctcgagctggacttcaactactgcgagggcaccaccgtggtcatcaccgagaactgcgggacgcggggcccctccctgcgcaccaccaccgtgagcgggaagctcatccacgagtggtgctgccggtcctgcacgctgcccccgctgcgctacatgggcgaggacgggtgctggtacggcatggagatccggcccatcaacgagaaggaggagaacatggtgaagagcctcgtctccgccggcagcgggaaggtggacaacttcaccatgggcgtgctgtgcctggcgatcctcttcgaggaggtcatgcgcgggaagttcggcaagaagcacatgatcgccggggtgctgttcaccttcgtgctgctcctgtccggccagatcacctggcgggacatggcccacacgctgatcatgatcggcagcaacgcctccgaccgcatggggatgggcgtcacctacctcgccctgatcgcgaccttcaagatccagcccttcctggccctcgggttcttcctgcggaagctgaccagccgcgagaacctcctgctgggcgtgggcctcgccatggccacgaccctgcagctgcccgaggacatcgagcagatggcgaacgggatcgccctcggcctgatgaccctgaagctcatcacccagttcgagacgtaccagctgtggaccgccctggtgagcctcacctgctccaacaccatcttcacgctgaccgtcgcctggcggaccgccaccctgatcctcgcgggggtgagcctgctgccgctctgccagtccagctccatgcgcaagacggactggctgcccatgaccgtcgccgccatgggcgtgccccccctgccgctcttcatcttcagcctgaaggacacccccaagcgccggtcctggcccctgaacgagggggtgatggccgtcggcctcgtgagcatcctggcctccagcctgctccgcaacgacgtgcccatggcgggcccgctggtcgccgggggcctgctcatcgcctgctacgtgatcaccgggacgtccgccgacctgaccgtggagaaggccgcggacgtcacctgggaggaggaggccgagcagaccggcgtgagccacaacctgatgatcacggtggacgacgacgggaccatgcggatcaaggacgacgagaccgagaacatcctcaccgtcctgctgaagaccgccctcctgatcgtgtccggcatcttcccctacagcatccccgccacgctgctcgtgtggcacacctggcagaagcagacccagcgctccggcgtcctgtgggacgtgcccagcccgcccgagacccagaaggccgagctggaggagggggtgtaccggatcaagcagcagggcatcttcgggaagacgcaggtcggcgtgggggtgcagaaggagggcgtcttccacaccatgtggcacgtgacccgcggcgcggtgctcacccacaacgggaagcggctggagcccaactgggcctccgtcaagaaggacctgatcagctacggcgggggctggcgcctctccgcccagtggcagaagggggaggaggtgcaggtgatcgccgtcgagcccggcaagaacccgaagaacttccagacgatgcccggcatcttccagaccaccatgggggagatcggcgcgatcgccctggacttcaagcccgggaccagcggcagcccgatcatcaaccgggagggcaaggtggtggggctgtacggcaacggggtcgtgacgaagaacggcgggtacgtgtccggcatcgcccagaccaacgccgagcccgacggccccacccccgagctggaggaggagatgttcaagaagcgcaacctcaccatcatggacctgcacccggggagcggcaagacgcggaagtacctgcccgccatcgtccgcgaggcgatcaagcggcgcctccggaccctgatcctggcccccacccgcgtggtggccgccgagatggaggaggccctcaaggggctgcccatccggtaccagaccacggcgaccaagtccgagcacaccggccgcgagatcgtcgacctgatgtgccacgccaccttcacgatgcggctcctgagcccggtgcgcgtgcccaactacaacctgatcatcatggacgaggcccacttcaccgaccccgcctccatcgccgcgcgggggtacatcagcacccgcgtcggcatgggcgaggccgccgccatcttcatgaccgcgacgcccccggggaccgccgaggccttcccccagtccaacgcccccatccaggacgaggagcgcgacatccccgagcggagctggaactccggcaacgagtggatcaccgacttcgtggggaagaccgtgtggttcgtcccgagcatcaaggccggcaacgacatcgcgaactgcctccgcaagaacgggaagaaggtgatccagctgtcccggaagacgttcgacaccgagtaccagaagacccgcctgaacgactgggacttcgtggtcaccacggacatcagcgagatgggcgccaacttcaaggccgaccgggtgatcgacccccgccggtgcctcaagcccgtgatcctgaccgacggccccgagcgcgtcatcctggccgggccgatgcccgtgaccgccgcgtccgccgcccagcggcgcggccgggtggggcgcaacccccagaaggagaacgaccagtacatcttcaccggccagcccctcaacaacgacgaggaccacgcccactggacggaggccaagatgctgctggacaacatcaacaccccggaggggatcatccccgcgctcttcgagcccgagcgggagaagagcgccgccatcgacggcgagtaccgcctgaagggcgagtcccggaagaccttcgtcgagctgatgcgccggggggacctccccgtgtggctggcccacaaggtcgcgagcgagggcatcaagtacaccgaccgcaagtggtgcttcgacggggagcggaacaaccagatcctggaggagaacatggacgtggagatctggaccaaggagggcgagcgcaagaagctccgcccgcggtggctggacgcccgcacgtactccgaccccctggccctcaaggagttcaaggacttcgccgccggccggaagagcatcgcgctggacctggtgaccgagatcgggcgcgtcccctcccacctcgcctaccggacccgcaacgccctggacaacctggtgatgctccacaccagcgagcacggcgggcgggcctaccgccacgccgtggaggagctgccggagacgatggagaccctgctcctgctgggcctcatgatcctgctgaccgggggcgcgatgctcttcctgatcagcggcaaggggatcggcaagacctccatcgggctgatctgcgtcatcgtgagctccggcatgctctggatggccgacgtgcccctgcagtggatcgccagcgccatcgtcctggagttcttcatgatggtgctcctgatccccgagcccgagaagcagcggacgccgcaggacaaccagctggcctacgtggtcatcgggatcctcaccctggcggccatcgtggccgccaacgagatgggcctgctcgagaccaccaagcgcgacctgggcatgtccaaggagcccggggtggtcagccccacgtcctacctggacgtggacctccaccccgccagcgcgtggaccctgtacgccgtggccaccaccgtcatcacgccgatgctgcggcacaccatcgagaactccaccgccaacgtgagcctcgcggccatcgccaaccaggccgtggtcctgatgggcctggacaaggggtggcccatctccaagatggacctcggcgtgcccctgctggccctcgggtgctacagccaggtgaaccccctgaccctgacggcggccgtcctcctgctggtgacccactacgccatcatcggcccgggcctccaggccaaggccacccgcgaggcgcagaagcggaccgccgccgggatcatgaagaaccccacggtggacggcatcatgaccatcgacctggaccccgtcatctacgaccccaagttcgagaagcagctggggcaggtgatgctcctggtgctgtgcgccgtccagctcctgctgatgcgcacctcctgggccctctgcgaggcgctgaccctggccacgggcccgatcaccaccctctgggagggcagccccgggaagttctggaacaccacgatcgccgtgtccatggccaacatcttccggggcagctacctggcgggggccggcctggccttctccatcatgaagagcgtggggaccggccgccggggcaccgggtcccagggcgagaccctcggggagaagtggaagaagaagctgaaccagctgagccgcaaggagttcgacctctacaagaagagcggcatcacggaggtcgaccggaccgaggccaaggaggggctgaagcgcggcgagaccacccaccacgccgtgtcccggggcagcgcgaagctgcagtggttcgtggagcgcaacatggtcatccccgaggggcgcgtgatcgacctcggctgcgggcggggcgggtggtcctactactgcgccggcctgaagaaggtgaccgaggtccgcggctacacgaaggggggccccgggcacgaggagccggtgcccatgagcacctacggctggaacatcgtgaagctgatgtccgggaaggacgtcttctacctcccccccgagaagtgcgacaccctgctgtgcgacatcggcgagagctccccgagccccaccgtggaggagtcccggacgatccgcgtgctgaagatggtcgagccctggctcaagaacaaccagttctgcatcaaggtgctgaacccctacatgccgaccgtgatcgagcacctggagcggctccagcgcaagtacggcgggatgctggtccggaaccccctgagccgcaactccacccacgagatgtactggatcagcaacggcaccgggaacatcgtgtccagcgtgaacatggtctcccggctcctgctgaaccgcttcacgatgacccaccggcgccccaccatcgagaaggacgtggacctcggcgccggcacccggcacgtcaacgccgagccggagacgcccaacatggacgtgatcggggagcgcatcaagcggatcaaggaggagcacagctccacctggcactacgacgacgagaacccctacaagacctgggcctaccacggcagctacgaggtgaaggcgaccgggtccgccagcagcatgatcaacggcgtcgtgaagctgctgacgaagccctgggacgtggtcccgatggtgacccagatggccatgaccgacaccacgcccttcgggcagcagcgcgtgttcaaggagaaggtcgacacccggaccccccgccccatgccgggcacccggaaggtgatggagatcacggccgagtggctctggcgcaccctgggccgcaacaagaagccccggctgtgcacccgcgaggagttcaccaagaaggtgcggacgaacgccgcgatgggggccgtcttcaccgaggagaaccagtgggactccgcccgcgccgcggtggaggacgaggagttctggaagctcgtggaccgggagcgcgagctgcacaagctgggcaagtgcgggagctgcgtctacaacatgatgggcaagcgggagaagaagctcggggagttcggcaaggccaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggcgatgtacgccgacgacaccgccggctgggacacccgcatcacggaggacgacctgcacaacgaggagaagatcacccagcagatggaccccgagcaccggcagctcgccaacgccatcttcaagctgacctaccagaacaaggtggtcaaggtgcagcgcccgacccccaaggggacggtgatggacatcatcagccggaaggaccagcgcggctccggccaggtcgggacctacggcctgaacaccttcaccaacatggaggcgcagctcgtgcggcagatggagggggagggcgtgctgagcaaggccgacctggagaacccccacctcctggagaagaagatcacccagtggctggagacgaagggggtcgagcgcctcaagcggatggccatctccggcgacgactgcgtggtgaagcccatcgacgaccgcttcgccaacgccctgctggcgctcaacgacatgggcaaggtccggaaggacatcccgcagtggcagcccagcaaggggtggcacgactggcagcaggtgcccttctgctcccaccacttccacgagctgatcatgaaggacggccgcaagctggtggtcccctgccgcccgcaggacgagctcatcgggcgggcccgcatcagccagggcgccgggtggtccctgaaggagaccgcctgcctgggcaaggcctacgcgcagatgtggagcctcatgtacttccaccggcgcgacctgcggctggcctccaacgccatctgcagcgccgtgcccgtgcactggatccccacctcccgcaccacgtggagcatccacgcgcaccaccagtggatgaccaccgaggacatgctcaccgtctggaaccgggtgtggatcgaggacaacccctggatggaggacaagacgccggtgaccacctgggaggacgtcccctacctgggcaagcgcgaggaccagtggtgcgggagcctgatcggcctcacctcccgggccacgtgggcccagaacatcctgaccgccatccagcaggtgcgcagcctgatcggggacgaggagttcctcgactacatgccctccatgaagcggttccgcaaggaggaggagagcgagggcgccatctggtga

SEQ ID NO: 10302 - RNA, 9873 nt, synthetic construct
  misc_feature 1..9873: note = derived and/or modified CDS sequence (opt1) from DENV-3__EU482461__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtgacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccggtgcgggtgcccaactacaacctcgtcatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtggggaagaccgtctggttcgtgcccagcatcaaggccggcaacgacatcgccaactgcctgcggaagaacgggaagaaggtgatccagctgtcccgcaagaccttcgacaccgagtaccagaagacgcggctcaacgactgggacttcgtcgtgaccaccgacatcagcgagatgggcgcgaacttcaaggccgaccgcgtgatcgacccccggcgctgcctgaagcccgtcatcctgaccgacggccccgagcgggtgatcctcgccgggccgatgcccgtgacggccgcctccgcggcccagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtggagctcatgcggcgcggggacctgcccgtctggctggcccacaaggtggccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtcaccgagatcgggcgggtgccctcccacctggcgtaccgcacgcggaacgccctggacaacctcgtgatgctgcacaccagcgagcacggcgggcgcgcctaccggcacgccgtcgaggagctgccggagaccatggagaccctcctgctgctcggcctgatgatcctgctcaccggcggggccatgctgttcctgatcagcgggaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcgcaccccgcaggacaaccagctcgcctacgtcgtgatcgggatcctgaccctggccgcgatcgtggccgccaacgagatgggcctcctggagacgaccaagcgggacctgggcatgtccaaggagcccggggtcgtgagccccacctcctacctcgacgtggacctgcaccccgccagcgcctggaccctgtacgcggtcgccacgaccgtgatcaccccgatgctccgccacaccatcgagaactccacggccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacccactacgccatcatcggcccgggcctgcaggccaaggccacgcgggaggcccagaagcgcaccgcggccgggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcggacgagctgggccctgtgcgaggccctgaccctcgcgaccggccccatcaccacgctgtgggagggctccccggggaagttctggaacaccaccatcgccgtgagcatggccaacatcttccgcggctcctacctggccggggcgggcctcgccttcagcatcatgaagtccgtcgggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtgagccgcggctccgccaagctccagtggttcgtcgagcggaacatggtgatccccgaggggcgcgtgatcgacctgggctgcgggcgcggcgggtggagctactactgcgcgggcctgaagaaggtcaccgaggtgcggggctacaccaagggcggccccgggcacgaggagcccgtgccgatgtccacctacggctggaacctcgtcaagctgatgagcgggaaggacgtgttctacctgccgcccgagaagtgcgacacgctgctctgcgacatcggcgagtccagcccctccccgaccgtggaggagagccgcaccatccgggtcctgaagatggtggagccctggctgaagaacaaccagttctgcatcaaggtgctcaacccctacatgcccaccgtcatcgagcacctggagcgcctgcagcggaagtacggcgggatgctcgtgcgcaacccgctgtcccggaacagcacgcacgagatgtactggatctccaacggcaccgggaacatcgtgagctccgtcaacatggtgagccgcctgctcctgaaccggttcaccatgacccaccgccggcccacgatcgagaaggacgtcgacctgggcgccggcacccgccacgtgaacgccgagcccgagaccccgaacatggacgtgatcggggagcggatcaagcgcatcaaggaggagcactccagcacctggcactacgacgacgagaacccctacaagacgtgggcctaccacggctcctacgaggtcaaggccaccgggagcgcgagctccatgatcaacggcgtggtgaagctcctgaccaagccctgggacgtcgtgcccatggtgacccagatggccatgacggacaccaccccgttcgggcagcagcgggtcttcaaggagaaggtggacacccgcacgccccggcccatgcccggcacccgcaaggtgatggagatcaccgccgagtggctgtggcggaccctcggccgcaacaagaagccgcgcctgtgcacgcgggaggagttcaccaagaaggtccgcaccaacgccgccatgggggcggtgttcaccgaggagaaccagtgggacagcgcccgggccgccgtggaggacgaggagttctggaagctggtcgaccgcgagcgggagctccacaagctgggcaagtgcgggtcctgcgtgtacaacatgatgggcaagcgcgagaagaagctgggggagttcggcaaggcgaagggcagccgggccatctggtacatgtggctcggggcccgctacctggagttcgaggccctgggcttcctcaacgaggaccactggttctcccgggagaacagctactccggggtggagggcgaggggctgcacaagctgggctacatcctccgcgacatcagcaagatccccggcggggccatgtacgcggacgacacggccggctgggacacccggatcaccgaggacgacctgcacaacgaggagaagatcacccagcagatggaccccgagcaccgccagctggccaacgccatcttcaagctcacgtaccagaacaaggtcgtgaaggtgcagcggcccaccccgaaggggaccgtcatggacatcatctcccgcaaggaccagcggggcagcggccaggtggggacctacggcctgaacaccttcacgaacatggaggcccagctggtgcgccagatggagggggagggcgtcctctccaaggcggacctggagaacccccacctcctcgagaagaagatcacccagtggctggagaccaagggggtggagcggctgaagcgcatggccatcagcggcgacgactgcgtggtcaagcccatcgacgaccggttcgccaacgccctcctggccctgaacgacatgggcaaggtgcgcaaggacatcccccagtggcagccgtccaaggggtggcacgactggcagcaggtccccttctgcagccaccacttccacgagctcatcatgaaggacggccggaagctggtcgtgccctgccgcccccaggacgagctgatcgggcgcgcgcggatctcccagggcgccgggtggagcctcaaggagaccgcctgcctgggcaaggcctacgcccagatgtggtccctgatgtacttccaccgccgggacctccgcctggcgagcaacgccatctgctccgccgtgccggtccactggatccccacgagccggaccacctggagcatccacgcccaccaccagtggatgaccacggaggacatgctgaccgtgtggaaccgcgtgtggatcgaggacaacccctggatggaggacaagacccccgtcaccacgtgggaggacgtgccgtacctcggcaagcgggaggaccagtggtgcgggtccctgatcggcctgaccagccgcgcgacctgggcccagaacatcctcaccgccatccagcaggtccggtccctgatcggggacgaggagttcctggactacatgcccagcatgaagcgcttccggaaggaggaggagtccgagggcgccatctggtga

SEQ ID NO: 10303 - RNA, 9873 nt, synthetic construct
  misc_feature 1..9873: note = derived and/or modified CDS sequence (opt1) from DENV-3__EU482462__SS-prME
  source 1..9873: mol_type = other RNA
accagcctctgcctcatgatgatgctccccgcgaccctggccttccacctcacgagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggcccggaacaagcccaccctggacatcgagctgcagaagaccgaggccacccagctcgcgacgctgcgcaagctgtgcatcgagggcaagatcaccaacatcaccaccgacagccggtgccccacgcagggcgaggccatcctcccggaggagcaggaccagaactacgtgtgcaagcacacctacgtcgaccgcgggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcggaccggcctggacttcaacgagatgatcctcctgaccatgaagaacaaggcgtggatggtccaccgccagtggttcttcgacctgcccctcccctggacgagcggcgccaccaccgagacccccacgtggaaccggaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccgcctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccggctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccgcggcgcccggcgcatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccggagcaccacccgcatggagaacctcctgtggaagcagatcgcgaacgagctgaactacatcctctgggagaacaacatcaagctgacggtggtcgtgggggacatcatcggcgtgctggagcagggcaagcggaccctcacgccccagccgatggacctgaagtactcctggaagacctgggggaaggccaagatcgtcacggccgagacccagaacagctccttcatcatcgacggccccaacacccccgagtgccccagcgcctcccgcgcgtggaacgtgtgggaggtggaggactacgggttcggcgtcttcaccacgaacatctggctgaagctccgggaggtgtacacccagagctgcgaccaccgcctgatgagcgccgccatcaaggacgagcgggccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccgcccgggctaccacacgcagaccgccgggccctggcacctcggcaagctggagctggacttcaactactgcgagggcaccaccgtggtcatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtctccgccggcagcgggaaggtggacaacttcaccatgggcgtgctgtgcctcgccatcctgttcgaggaggtcatgcgcgggaagttcggcaagaagcacatgatcgcgggggtgctgttcaccttcgtgctcctgctgtccggccagatcacgtggaaggacatggcccacaccttcatcatgatcggcagcaacgcctccgaccggatggggatgggcgtcacctacctcgccctgatcgccaccttcaagatccagcccttcctggcgctcgggttcttcctgcgcaagctgacgagccgggagaacctcctgctgggcgtgggcctcgccatggccaccaccctgcagctgcccgaggacatcgagcagatggccaacgggatcgcgctcggcctgatgaccctgaagctcatcacgcagttcgagacctaccagctgtggaccgccctggtgagcctgacctgctccaacacgatcttcaccctgaccgtcgcctggcgcaccgccacgctggtgctcgccggggtcagcctgctgccgctctgccagtccagctccatgcggaagaccgactggctgcccatgaccgtggcggccatgggcgtgccgcccctccccctcttcatcttcagcctgaaggacacccccaagcgccgctcctggcccctgaacgagggggtcatggccgtgggcctcgtgagcatcctggcctccagcctgctccggaacgacgtccccatggccggcccgctggtggccggcgggctgctcatcgcctgctacgtgatcacggggacctccgccgacctgaccgtcgagaaggccgccgacgtgacctgggaggaggaggcggagcagacgggggtgagccacaacctgatgatcaccgtcgacgacgacgggaccatgcgcatcaaggacgacgagaccgagaacatcctcaccgtgctgctgaagacggccctcctgatcgtgtccggcatcttcccctacagcatccccgccaccctgctcgtctggcacacctggcagaagcagacccagcggtccggcgtgctgtgggacgtgcccagcccgcccgagacgcagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacgcacaacgggaagcgcctggagcccaactgggcgtccgtgaagaaggacctgatcagctacggcgggggctggcggctctccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtcgggctgtacggcaacggggtggtgaccaagaacggcgggtacgtctccggcatcgcccagaccaacgccgagcccgacggccccacgcccgagctggaggaggagatgttcaagaagcggaacctcaccatcatggacctgcacccggggagcggcaagacccgcaagtacctgcccgccatcgtgcgggaggccatcaagcgccggctccgcaccctgatcctggcgcccacgcgggtggtcgccgccgagatggaggaggccctcaaggggctgcccatccgctaccagaccaccgccaccaagtccgagcacacgggccgggagatcgtggacctgatgtgccacgcgaccttcaccatgcgcctcctgagcccggtgcgggtccccaactacaacctgatcatcatggacgaggcccacttcaccgaccccgcctccatcgccgcccgcgggtacatcagcacgcgggtgggcatgggcgaggcggccgccatcttcatgaccgccacgcccccggggaccgcggaggccttcccccagtccaacgcccccatccaggacgaggagcgcgacatccccgagcgcagctggaactccggcaacgagtggatcacggacttcgtggggaagaccgtctggttcgtgccgagcatcaaggccggcaacgacatcgccaactgcctccggaagaacgggaagaaggtgatccagctgtcccgcaagaccttcgacaccgagtaccagaagacgcggctgaacgactgggacttcgtcgtgaccaccgacatcagcgagatgggcgcgaacttcaaggccgaccgcgtgatcgacccccggcgctgcctcaagcccgtcatcctgaccgacggccccgagcgggtgatcctggccgggccgatgcccgtgacggccgcctccgcggcccagcgccggggccgcgtcgggcggaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgcgagaagtccgcggccatcgacggcgagtaccggctgaagggcgagtcccgcaagaccttcgtggagctgatgcggcgcggggacctccccgtctggctggcccacaaggtggccagcgagggcatcaagtacacggaccggaagtggtgcttcgacggggagcgcaacaaccagatcctggaggagaacatggacgtggagatctggaccaaggagggcgagcggaagaagctccgcccgcgctggctggacgcgcggacctactccgaccccctggccctcaaggagttcaaggacttcgccgccggccgcaagagcatcgccctggacctggtcaccgagatcgggcgggtgccctcccacctcgcgtaccgcacgcggaacgccctggacaacctggtgatgctccacaccagcgagcacggcgggcgcgcctaccggcacgccgtcgaggagctgccggagaccatggagaccctgctcctgctgggcctcatgatcctgctgaccggcggggccatgctgttcctgatcagcgggaaggggatcggcaagacctccatcgggctgatctgcgtgatcgtgagctccggcatgctctggatggcggacgtccccctgcagtggatcgccagcgccatcgtgctggagttcttcatgatggtgctcctgatccccgagcccgagaagcagcgcaccccgcaggacaaccagctggcctacgtcgtgatcgggatcctcaccctggccgcgatcgtggccgccaacgagatgggcctgctcgagacgaccaagcgggacctgggcatgtccaaggagcccggggtcgtgagccccacctcctacctggacgtggacctccaccccgccagcgcctggaccctgtacgcggtcgccacgaccgtgatcaccccgatgctgcgccacaccatcgagaactccacggccaacgtgagcctcgccgcgatcgccaaccaggccgtcgtgctgatgggcctggacaaggggtggcccatctccaagatggacctcggcgtgcccctgctggccctcgggtgctacagccaggtcaaccccctgaccctgaccgccgcggtgctcctgctggtgacccactacgccatcatcggcccgggcctccaggccaaggccacgcgggaggcccagaagcgcaccgcggccgggatcatgaagaaccccaccgtcgacggcatcatgaccatcgacctggaccccgtgatctacgactccaagttcgagaagcagctgggccaggtgatgctcctggtcctgtgcgccgtgcagctcctgctgatgcggacgagctgggccctctgcgaggccctgaccctggcgaccggccccatcaccacgctctgggagggctccccggggaagttctggaacaccaccatcgccgtgagcatggccaacatcttccgcggctcctacctggccggggcgggcctggccttcagcatcatgaagtccgtcgggaccggccggcgcggcacggggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagaccacgcaccacgccgtgagccgcggctccgccaagctgcagtggttcgtcgagcggaacatggtgatccccgaggggcgcgtgatcgacctcggctgcgggcgcggcgggtggagctactactgcgcgggcctgaagaaggtcaccgaggtgcggggctacaccaagggcggccccgggcacgaggagcccgtgccgatgtccacctacggctggaacatcgtcaagctgatgagcgggaaggacgtgttctacctgccgcccgagaagtgcgacacgctgctgtgcgacatcggcgagtccagcccctccccgaccgtggaggagagccgcaccatccgggtcctgaagatggtggagccctggctcaagaacaaccagttctgcatcaaggtgctgaacccctacatgcccaccgtcatcgagcacctggagcgcctccagcggaagtacggcgggatgctggtgcgcaacccgctgtcccggaacagcacgcacgagatgtactggatctccaacggcaccgggaacatcgtgagctccgtcaacatggtgagccgcctcctgctgaaccggttcaccatgacccaccgccggcccacgatcgagaaggacgtcgacctcggcgccggcacccgccacgtgaacgccgagcccgagaccccgaacatggacgtgatcggggagcggatcaagcgcatcaaggaggagcactccagcacctggcactacgacgacgagaacccctacaagacgtgggcctaccacggctcctacgaggtcaaggccaccgggagcgcgagctccatgatcaacggcgtggtgaagctgctgaccaagccctgggacgtcgtgcccatggtgacccagatggccatgacggacaccaccccgttcgggcagcagcgggtcttcaaggagaaggtggacacccgcacgccccggcccatgcccggcacccgcaaggtgatggagatcaccgccgagtggctctggcggaccctgggccgcaacaagaagccgcgcctgtgcacgcgggaggagttcaccaagaaggtccgcaccaacgccgccatgggggcggtgttcaccgaggagaaccagtgggacagcgcccgggccgccgtggaggacgaggagttctggaagctcgtcgaccgcgagcgggagctgcacaagctgggcaagtgcgggtcctgcgtgtacaacatgatgggcaagcgcgagaagaagctcggggagttcggcaaggcgaagggcagccgggccatctggtacatgtggctgggggcccgctacctggagttcgaggccctcggcttcctgaacgaggaccactggttctcccgggagaacagctactccggggtggagggcgaggggctgcacaagctcggctacatcctgcgcgacatcagcaagatccccggcggggccatgtacgcggacgacacggccggctgggacacccggatcaccgaggacgacctgcacaacgaggagaagatcacccagcagatggaccccgagcaccgccagctcgccaacgccatcttcaagctgacgtaccagaacaaggtcgtgaaggtgcagcggcccaccccgaaggggaccgtcatggacatcatctcccgcaaggaccagcggggcagcggccaggtggggacctacggcctgaacaccttcacgaacatggaggcccagctcgtgcgccagatggagggggagggcgtcctgtccaaggcggacctggagaacccccacctcctggagaagaagatcacccagtggctggagaccaagggggtggagcggctcaagcgcatggccatcagcggcgacgactgcgtggtcaagcccatcgacgaccggttcgccaacgccctgctggccctcaacgacatgggcaaggtgcgcaaggacatcccccagtggcagccgtccaaggggtggcacgactggcagcaggtccccttctgcagccaccacttccacgagctgatcatgaaggacggccggaagctggtcgtgccctgccgcccccaggacgagctcatcgggcgcgcgcggatctcccagggcgccgggtggagcctgaaggagaccgcctgcctgggcaaggcctacgcccagatgtggtccctcatgtacttccaccgccgggacctgcgcctggcgagcaacgccatctgctccgccgtgccggtccactggatccccatcagccggacgacctggagcatccacgcccaccaccagtggatgaccaccgaggacatgctcacggtgtggaaccgcgtgtggatcgaggacaacccctggatggaggacaagacccccgtcaccacctgggaggacgtgccgtacctgggcaagcgggaggaccagtggtgcgggtccctgatcggcctcacgagccgcgcgacctgggcccagaacatcctgaccgccatccagcaggtccggtccctgatcggggacgaggagttcctcgactacatgcccagcatgaagcgcttccggaaggaggaggagtccgagggcgccatctggtga

SEQ ID NO: 10304 - RNA, 9873 nt, synthetic construct
  misc_feature 1..9873: note = derived and/or modified CDS sequence (opt1) from DENV-3__EU660407__SS-prME
  source 1..9873: mol_type = other RNA
accagcctgtgcctcatgatgatgctgcccgccaccctggccttccacctcaccagccgggacggcgagccgcggatgatcgtggggaagaacgagcggggcaagagcctgctgttcaagaccgcgagcgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtactcctggaagacctgggggaaggcgaagatcgtgacggccgagacccagaacagctccttcatcatcgacggccccaacacccccgagtgccccagcgcctcccgggcctggaacgtgtgggaggtcgaggactacgggttcggcgtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacaccctctggtccaacggcgtgctggagaacgacatgatcatccccaagagcctggcggggcccatctcccagcacaaccaccggccgggctaccacacgcagaccgccgggccctggcacctcggcaagctggagctggacttcaactactgcgagggcaccaccgtcgtgatcacggagaactgcgggacccgcggccccagcctccggaccaccacggtgtccgggaagctgatccacgagtggtgctgccgcagctgcaccctgcccccgctccggtacatgggcgaggacgggtgctggtacggcatggagatccgccccatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgccggggtgctgttcaccttcgtcctcctgctgagcggccagatcacgtggcgcgacatggcgcacaccctcatcatgatcggctccaacgccagcgaccggatggggatgggcgtgacctacctggccctgatcgccaccttcaagatccagcccttcctcgccctggggttcttcctgcgcaagctcacgtcccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgcagcaacacgatcttcaccctgaccgtggcctggcgcaccgccacgctcatcctggccggggtctccctgctcccgctgtgccagagctccagcatgcggaagaccgactggctgcccatgaccgtggccgcgatgggcgtgccgcccctgccgctgttcatcttctccctgaaggacacccccaagcgccgcagctggcccctcaacgagggggtcatggccgtgggcctggtgtccatcctggccagctccctcctgcggaacgacgtccccatggccggcccgctggtggccgggggcctcctgatcgcgtgctacgtgatcacggggaccagcgccgacctgaccgtcgagaaggccgccgacgtgacctgggaggaggaggccgagcagacgggcgtgtcccacaacctcatgatcaccgtcgacgacgacgggaccatgcgcatcaaggacgacgagaccgagaacatcctgaccgtgctgctcaagacggcgctgctgatcgtgagcggcatcttcccctactccatccccgccaccctcctggtctggcacacctggcagaagcagacccagcggagcggcgtgctgtgggacgtgccctccccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggccagcgtgaagaaggacctcatctcctacggcgggggctggcggctgagcgcgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggacctccggcagcccgatcatcaaccgcgagggcaaggtggtcgggctgtacggcaacggggtggtgaccaagaacggcgggtacgtcagcggcatcgcgcagaccaacgccgagcccgacggccccacgcccgagctcgaggaggagatgttcaagaagcggaacctgaccatcatggacctgcacccggggtccggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagagcgagcacacgggccgggagatcgtggacctcatgtgccacgccaccttcaccatgcgcctgctgtccccggtgcgggtccccaactacaacctcatcatcatggacgaggcgcacttcaccgaccccgccagcatcgccgcccgcgggtacatctccacgcgggtgggcatgggcgaggccgcggccatcttcatgaccgccacgccgcccgggaccgccgaggcgttcccccagagcaacgcccccatccaggacgaggagcgcgacatccccgagcgctcctggaacagcggcaacgagtggatcacggacttcgtggggaagaccgtctggttcgtgccctccatcaaggccggcaacgacatcgccaactgcctgcggaagaacgggaagaaggtgatccagctgagccgcaagaccttcgacaccgagtaccagaagacgaagctcaacgactgggacttcgtcgtgaccaccgacatctccgagatgggcgccaacttcaaggcggaccgggtgatcgacccccgccggtgcctgaagcccgtcatcctgaccgacggccccgagcgcgtgatcctcgccgggccgatgcccgtgacggccgccagcgccgcgcagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagagccggaagaccttcgtggagctcatgcgccgcggggacctgcccgtctggctggcccacaaggtggcctccgagggcatcaagtacacggaccgcaagtggtgcttcgacggggagcggaacaaccagatcctcgaggagaacatggacgtggagatctggaccaaggagggcgagcgcaagaagctgcggccgcgctggctggacgcccgcacctacagcgaccccctcgcgctgaaggagttcaaggacttcgccgccggccggaagtccatcgccctggacctcgtcaccgagatcgggcgcgtgcccagccacctggcctaccggacgcgcaacgcgctggacaacctcgtgatgctgcacacctccgagcacggcgggcgggcctaccgccacgccgtcgaggagctgccggagaccatggagaccctcctgctgctcggcctgatgatcctgctcaccggcggggccatgctgttcctgatcagcgggaaggggatcggcaagaccagcatcgggctcatctgcgtgatcgtgtccagcggcatgctgtggatggccgacgtccccctgcagtggatcgcgtccgccatcgtgctcgagttcttcatgatggtgctgctgatccccgagcccgagaagcagcggaccccgcaggacaaccagctcgcctacgtcgtgatcgggatcctgaccctggccgccatcgtggcggccaacgagatgggcctcctggagacgaccaagcgcgacctgggcatgagcaaggagcccggggtcgtgtcccccaccagctacctcgacgtggacctgcaccccgcctccgcctggaccctgtacgccgtcgcgacgaccgtgatcaccccgatgctccggcacaccatcgagaacagcacggccaacgtgtccctggccgccatcgcgaaccaggccgtcgtgctgatgggcctcgacaaggggtggcccatcagcaagatggacctgggcgtgcccctgctcgccctggggtgctactcccaggtcaaccccctgaccctcaccgccgccgtgctgctgctcgtgacccactacgcgatcatcggcccgggcctgcaggccaaggccacgcgcgaggcccagaagcggaccgccgcggggatcatgaagaaccccaccgtcgacggcatcatgaccatcgacctggaccccgtgatctacgacagcaagttcgagaagcagctcggccaggtgatgctgctggtcctctgcgccgtgcagctgctgctcatgcgcacgtcctgggccctgtgcgaggccctgaccctcgccaccggccccatcaccacgctgtgggagggcagcccggggaagttctggaacaccaccatcgcggtgtccatggccaacatcttccggggcagctacctggccggggccggcctcgcgttctccatcatgaagtccgtcgggaccggccgccggggcacggggtcccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagaccacgcaccacgccgtgtcccggggcagcgccaagctccagtggttcgtcgagcgcaacatggtgatccccgaggggcgggtgatcgacctgggctgcgggcgcggcgggtggtcctactactgcgccggcctgaagcgcgtcaccgaggtgcggggctacaccaagggcgggcccgggcacgaggagcccgtgccgatgagcacctacggctggaacatcgtcaagctcatgtccgggaaggacgtgttctacctgccgcccgagaagtgcgacacgctgctgtgcgacatcggcgagagctcccccagcccgaccgtggaggagtcccgcaccatccgggtcctcaagatggtggagccctggctgaagaacaaccagttctgcatcaaggtgctgaacccctacatgcccaccgtcatcgagcacctcgagcgcctgcagcggaagtacggcgggatgctggtgcgcaacccgctcagccggaactccacgcacgagatgtactggatcagcaacggcaccgggaacatcgtgtccagcgtcaacatggtgtcccgcctgctgctcaaccggttcaccatgacccaccgccggcccacgatcgagaaggacgtcgacctgggcgcgggcacccgccacgtgaacgccgagcccgagaccccgaacatggacgtgatcggggagcggatcaagcgcatcaaggaggagcacagctccacctggcactacgacgacgagaacccctacaagacgtgggcctaccacggcagctacgaggtcaaggccaccgggtccgccagcagcatgatcaacggcgtggtgaagctgctcaccaagccctgggacgtcgtgcccatggtgacccagatggcgatgacggacaccaccccgttcgggcagcagcgggtcttcaaggagaaggtggacacccgcacgccccggcccatgcccggcacccgcaaggtgatggagatcaccgccgagtggctgtggcggaccctgggccgcaacaagaagccgcgcctctgcacgcgggaggagttcaccaagaaggtccgcaccaacgccgccatgggggccgtgttcaccgaggagaaccagtgggactccgcgcgggccgccgtggaggacgaggagttctggaagctggtcgaccgcgagcgggagctgcacaagctcggcaagtgcgggagctgcgtgtacaacatgatgggcaagcgcgagaagaagctgggggagttcggcaaggccaagggctcccgggcgatctggtacatgtggctgggggcccgctacctcgagttcgaggccctgggcttcctgaacgaggaccactggttcagccgggagaactcctacagcggggtggagggcgaggggctccacaagctgggctacatcctgcgcgacatctccaagatccccggcggggccatgtacgccgacgacacggcgggctgggacacccggatcaccgaggacgacctccacaacgaggagaagatcacccagcagatggaccccgagcaccgccagctggccaacgccatcttcaagctgacgtaccagaacaaggtcgtgaaggtgcagcggcccaccccgaaggggaccgtcatggacatcatcagccgcaaggaccagcggggctccggccaggtggggacctacggcctcaacaccttcacgaacatggaggcccagctggtgcgccagatggagggggagggcgtcctgagcaaggccgacctcgagaacccccacctcctggagaagaagatcacccagtggctcgagaccaagggggtggagcggctgaagcgcatggcgatctccggcgacgactgcgtggtcaagcccatcgacgaccggttcgccaacgccctgctcgccctgaacgacatgggcaaggtgcgcaaggacatcccccagtggcagccgagcaaggggtggcacgactggcagcaggtccccttctgctcccaccacttccacgagctgatcatgaaggacggccggaagctcgtcgtgccctgccgcccccaggacgagctgatcgggcgcgcccggatcagccagggcgcggggtggtccctgaaggagaccgcctgcctcggcaaggcctacgcccagatgtggagcctgatgtacttccaccgccgggacctgcgcctcgcctccaacgcgatctgcagcgccgtgccggtccactggatccccacgtcccggaccacctggagcatccacgcccaccaccagtggatgaccacggaggacatgctgaccgtgtggaaccgcgtgtggatcgaggacaacccctggatggaggacaagacccccgtcaccacgtgggaggacgtgccgtacctgggcaagcgggaggaccagtggtgcgggagcctcatcggcctgacctcccgcgccacctgggcgcagaacatcctgaccgccatccagcaggtccggagcctcatcggggacgaggagttcctggactacatgccctccatgaagcgcttccggaaggaggaggagagcgagggcgccatctggtga

SEQ ID NO: 10305 - RNA, 9873 nt, synthetic construct
  misc_feature 1..9873: note = derived and/or modified CDS sequence (opt1) from DENV-3__EU660409__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgggacaagcggtccgtcgccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccggctcgcgacgctgcgcaagctgtgcatcgagggcaagatcaccaacatcaccaccgacagccggtgccccacgcagggcgaggccatcctcccggaggagcaggaccagaactacgtgtgcaagcacacctacgtcgaccgcgggtggggcaacgggtgcggcctgttcgggaagggctccctggtgacctgcgccaagttccagtgcctcgagctgatcgagggcaaggtggtccagtacgagaacctgaagtacaccgtgatcatcacggtgcacaccggggaccagcaccaggtcggcaacgacacccagggggccaccgtggagatcacgccccaggccagcaccgtcgaggcggtgctccccgagtacggcaccctggggctggagtgcagcccccggaccggcctcgacttcaacgagatgatcctgctgaccatgaagaacaaggcctggatggtgcaccgccagtggttcttcgacctcccgctgccctggacgagcggcgccaccaccgagacccccacgtggaaccggaaggagctgctcgtcaccttcaagaacgcccacgccaagaagcaggaggtggtggtcctggggtcccaggagggcgcgatgcacaccgccctgaccggggccacggagatccagaacagcggcgggacctccatcttcgccggccacctcaagtgccgcctgaagatggacaagctggagctcaagggcatgagctacgccatgtgcctgaacaccttcgtgctgaagaaggaggtgtccgagacccagcacgggacgatcctgatcaaggtcgagtacaagggcgaggacgcgccctgcaagatcccgttcagcaccgaggacgggcagggcaaggcccacaacggccggctcatcaccgccaaccccgtggtgaccaagaaggaggagcccgtcaacatcgaggccgagcccccgttcggggagagcaacatcgtgatcggcatcggggacaaggcgctgaagatcaactggtacaagaagggctccagcatcgggaagatgttcgaggccacggcccgcggcgcccggcgcatggccatcctgggcgacaccgcgtgggacttcgggtccgtgggcggggtcctcaacagcctgggcaagatggtgcaccagatcttcgggtccgcctacaccgccctgttcagcggcgtgtcctggatcatgaagatcggcatcggggtcctcctgacctggatcggcctgaacagcaagaacacgtccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacctggacggagcagtacaagttccaggccgactcccccaagcgcctcgccaccgccatcgccggcgcgtgggagaacggggtctgcggcatccggagcaccacccgcatggagaacctgctgtggaagcagatcgccaacgagctcaactacatcctgtgggagaacaacatcaagctgacggtggtggtcggggacatcatcggcgtgctcgagcagggcaagcggaccctgacgccccagcccatggagctgaagtactcctggaagacctgggggaaggccaagatcgtgacggccgagacccagaacagctccttcatcatcgacggcccgaacacccccgagtgccccagcgcgtcccgcgcctggaacgtctgggaggtggaggactacgggttcggcgtgttcaccacgaacatctggctcaagctgcgggaggtctacacccagagctgcgaccaccgcctgatgagcgccgccatcaaggacgagcgggccgtgcacgcggacatgggctactggatcgagtcccagaagaacgggagctggaagctcgagaaggcctccttcatcgaggtgaagacctgcacctggcccaagagccacaccctgtggtccaacggcgtcctggagagcgacatgatcatcccgaagtccctcgccgggcccatcagccagcacaaccaccgccccggctaccacacgcagaccgccgggccgtggcacctgggcaagctggagctcgacttcaactactgcgagggcaccaccgtggtgatcacggagaactgcgggacccggggcccctccctgcgcaccaccacggtcagcgggaagctgatccacgagtggtgctgccggtcctgcaccctgccgcccctccgctacatgggcgaggacgggtgctggtacggcatggagatccggccgatcaacgagaaggaggagaacatggtgaagtccctggtgtccgccggcagcgggaaggtcgacaacttcaccatgggcgcgctctgcctggccatcctgttcgaggaggtgatgcgcgggaagttcggcaagaagcacatgatcgccggggtcctgttcaccttcgtcctgctgctctccggccagatcacgtggcgggacatggcccacaccctgatcatgatcggcagcaacgcctccgaccgcatggggatgggcgtgacctacctggcgctcatcgccaccttcaagatccagcccttcctggccctggggttcttcctccggaagctgacgagccgcgagaacctgctcctgggcgtgggcctggccatggcgaccaccctccagctgcccgaggacatcgagcagatggccaacgggatcgccctgggcctcatgaccctgaagctgatcacgcagttcgagacctaccagctctggaccgccctggtcagcctgacctgctccaacacgatcttcaccctcaccgtggcctggcggaccgcgacgctgatcctggccggggtgagcctcctgcccctgtgccagtccagctccatgcgcaagaccgactggctcccgatggccgtcgccgccatgggcgtgccgcccctgcccctgttcatcttcagcctcaaggacaccccgaagcgccggtcctggcccctgaacgagggggtcatggcggtgggcctggtgagcatcctcgcctccagcctgctgcgcaacgacgtccccatggccggccccctcgtggccgggggcctgctgatcgcctgctacgtgatcaccgggacgtccgcggacctcaccgtcgagaaggtggccgacgtgacctgggaggaggaggccgagcagaccggcgtcagccacaacctgatgatcacggtggacgacgacgggaccatgcggatcaaggacgacgagaccgagaacatcctgaccgtgctcctgaagaccgccctgctcatcgtctccggcatcttcccgtacagcatccccgccacgctgctggtgtggcacacctggcagaagcagacccagcgctccggcgtgctctgggacgtccccagcccgcccgagacccagaaggcggagctggaggagggggtgtaccggatcaagcagcagggcatcttcgggaagacccaggtgggcgtcggggtgcagaaggagggcgtgttccacaccatgtggcacgtcacccgcggcgccgtgctgacccacaacgggaagcggctcgagcccaactgggcctccgtgaagaaggacctgatcagctacggcgggggctggcgcctgtccgcccagtggcagaagggggaggaggtccaggtgatcgcggtggagcccggcaagaaccccaagaacttccagacgatgcccggcatcttccagaccaccaccggggagatcggcgccatcgccctggacttcaagcccgggacgagcggcagccccatcatcaaccgggagggcaaggtcgtggggctctacggcaacggggtggtcaccaagaacggcgggtacgtgtccggcatcgcccagaccaacgccgagccggacggccccacccccgagctggaggaggagatgttcaagaagcgcaacctgacgatcatggacctccaccccgggagcggcaagacccggaagtacctgccggcgatcgtgcgcgaggccatcaagcggcgcctgcggaccctcatcctggcccccacccgcgtcgtggccgccgagatggaggaggcgctgaaggggctccccatccggtaccagacgaccgccaccaagtccgagcacaccggccgcgagatcgtggacctgatgtgccacgccacgttcaccatgcggctgctcagccccgtccgcgtgccgaactacaacctgatcatcatggacgaggcccacttcaccgaccccgcctccatcgcggcccgggggtacatcagcacccgcgtgggcatgggcgaggccgccgcgatcttcatgacggccacgccgcccgggaccgccgaggccttcccgcagtccaacgcccccatccaggacgaggagcgcgacatccccgagcggagctggaactccggcaacgagtggatcaccgacttcgtcgggaagacggtgtggttcgtgcccagcatcaaggcgggcaacgacatcgccaactgcctgcgcaagaacgggaagaaggtcatccagctctcccggaagaccttcgacaccgagtaccagaagacccgcctgaacgactgggacttcgtggtgacgaccgacatcagcgagatgggcgccaacttcaaggccgaccgggtcatcgacccgcgccggtgcctgaagcccgtgatcctcaccgacggccccgagcgcgtgatcctggccgggcccatgccggtcaccgcggcctccgccgcccagcggcgcggccgggtggggcgcaacccccagaaggagaacgaccagtacatcttcacgggccagcccctgaacaacgacgaggaccacgcccactggaccgaggcgaagatgctcctggacaacatcaacacccccgaggggatcatcccggccctgttcgagcccgagcgggagaagtccgccgccatcgacggcgagtaccgcctcaagggcgagtcccggaagaccttcgtggagctgatgcgccgcggggacctgcccgtctggctcgcgcacaaggtggccagcgagggcatcaagtacaccgaccgcaagtggtgcttcgacggggagcggaacaaccagatcctggaggagaacatggacgtcgagatctggacgaaggagggcgagcgcaagaagctgcgcccccggtggctcgacgcccgcacctactccgacccgctggccctgaaggagttcaaggacttcgccgcgggccgcaagagcatcgccctcgacctggtgaccgagatcgggcgcgtgccctcccacctggcctaccggacccgcaacgccctcgacaacctggtcatgctgcacacgagcgagcacggcgggcgggcctaccgccacgcggtggaggagctccccgagaccatggagaccctgctgctcctgggcctgatgatcctcctgaccgggggcgccatgctgttcctcatcagcggcaaggggatcggcaagacgtccatcgggctgatctgcgtgaccgtcagctccggcatgctgtggatggccgacgtgccgctccagtggatcgccagcgccatcgtgctggagttcttcatgatggtcctgctcatccccgagcccgagaagcagcggacgccccaggacaaccagctggcgtacgtggtgatcgggatcctgaccctcgccgccatcgtcgccgccaacgagatgggcctgctggagacgaccaagcgcgacctcggcatgtccaaggagccgggggtggtgagccccacctcctacctggacgtcgacctgcaccccgcgagcgcctggaccctctacgccgtggccacgaccgtgatcacccccatgctgcggcacaccatcgagaactccacggcgaacgtcagcctggccgccatcgccaaccaggccgtggtgctcatgggcctggacaaggggtggccgatctccaagatggacctgggcgtccccctcctggcgctggggtgctacagccaggtgaaccccctcaccctgaccgccgccgtgctgctcctggtcacccactacgccatcatcggccccggcctgcaggccaaggcgacgcgcgaggcccagaagcggaccgccgccgggatcatgaagaacccgaccgtggacggcatcatgaccatcgacctcgaccccgtgatctacgactccaagttcgagaagcagctggggcaggtcatgctgctcgtgctgtgcgccgtgcagctgctcctgatgcgcacgagctgggcgctgtgcgaggccctcaccctggccaccggccccatcaccacgctgtgggagggctcccccgggaagttctggaacaccaccatcgccgtcagcatggcgaacatcttccggggctcctacctcgccggggccggcctggccttcagcatcatgaagtccgtggggaccggccgccggggcacggggagccagggcgagaccctgggggagaagtggaagaagaagctcaaccagctgagccgcaaggagttcgacctgtacaagaagtccggcatcaccgaggtggaccggaccgaggccaaggaggggctcaagcgcggcgagaccacgcaccacgcggtcagccggggctccgccaagctgcagtggttcgtggagcgcaacatggtgatcccggaggggcgcgtcatcgacctgggctgcgggcggggcgggtggagctactactgcgccggcctcaagaaggtgaccgaggtgcgcggctacaccaagggcgggcccgggcacgaggagcccgtccccatgtccacctacggctggaacatcgtgaagctgatgagcgggaaggacgtgttctacctgccgcccgagaagtgcgacacgctgctctgcgacatcggcgagtccagcccctcccccaccgtcgaggagagccggaccatccgcgtgctgaagatggtggagccgtggctgaagaacaaccagttctgcatcaaggtcctcaacccctacatgcccaccgtgatcgagcacctggagcggctgcagcgcaagtacggcgggatgctcgtgcggaaccccctgtcccgcaacagcacgcacgagatgtactggatctccaacggcaccgggaacatcgtcagctccgtgaacatggtgagccggctgctcctgaaccgcttcaccatgacccaccggcgcccgacgatcgagaaggacgtcgacctgggcgccggcacccggcacgtgaacgccgagcccgagacccccaacatggacgtcatcggggagcgcatcaagcggatcaaggaggagcactccagcacctggcactacgacgacgagaacccgtacaagacgtgggcgtaccacggctcctacgaggtgaaggccaccgggagcgccagctccatgatcaacggcgtggtcaagctcctgaccaagccctgggacgtggtgcccatggtcacccagatggccatgacggacaccacccccttcgggcagcagcgcgtgttcaaggagaaggtggacacccggacgccgcgccccatgcccggcacccggaaggtcatggagatcaccgccgagtggctgtggcgcaccctcggccgcaacaagaagccccggctgtgcacgcgcgaggagttcaccaagaaggtgcggaccaacgcggccatgggggccgtgttcaccgaggagaaccagtgggacagcgcccgcgcggccgtcgaggacgaggagttctggaagctggtggaccgggagcgcgagctccacaagctgggcaagtgcgggtcctgcgtgtacaacatgatgggcaagcgggagaagaagctgggggagttcggcaaggccaagggcagccgcgccatctggtacatgtggctcggggcccggtacctggagttcgaggcgctgggcttcctcaacgaggaccactggttctcccgcgagaacagctactccggggtcgagggcgaggggctgcacaagctgggctacatcctccgggacatcagcaagatcccgggcggggccatgtacgccgacgacacggccggctgggacacccgcatcaccgaggacgacctgcacaacgaggagaagatcacccagcagatggaccccgagcaccggcagctggccaacgcgatcttcaagctcacgtaccagaacaaggtggtgaaggtccagcgccccacccccaaggggaccgtgatggacatcatctcccggaaggaccagcgcggcagcggccaggtggggacctacggcctgaacaccttcacgaacatggaggcccagctggtccggcagatggagggggagggcgtgctctccaaggccgacctggagaacccgcacctcctcgagaagaagatcacccagtggctggagaccaagggggtggagcgcctgaagcggatggccatcagcggcgacgactgcgtcgtgaagcccatcgacgaccgcttcgccaacgcgctcctggccctgaacgacatgggcaaggtgcggaaggacatcccccagtggcagccctccaaggggtggcacgactggcagcaggtcccgttctgcagccaccacttccacgagctcatcatgaaggacggccgcaagctggtggtgccctgccgcccccaggacgagctgatcgggcgggcccgcatctcccagggcgccgggtggagcctcaaggagaccgcctgcctgggcaaggcgtacgcccagatgtggtccctgatgtacttccaccggcgcgacctccggctggccagcaacgccatctgctccgcggtccccgtgcactggatcccgacgagccgcaccacctggagcatccacgcccaccaccagtggatgaccacggaggacatgctgaccgtgtggaaccgggtctggatcgaggacaacccctggatggaggacaagacccccgtgaccacgtgggaggacgtgccctacctcggcaagcgcgaggaccagtggtgcgggtccctgatcggcctgaccagccgggccacctgggcccagaacatcctcaccgccatccagcaggtccgctccctgatcggggacgaggagttcctggactacatgccgagcatgaagcggttccgcaaggaggaggagtccgagggcgcgatctggtga

SEQ ID NO: 10306 - RNA, 9873 nt, synthetic construct
  misc_feature 1..9873: note = derived and/or modified CDS sequence (opt1) from DENV-3__EU660410__SS-prME
  source 1..9873: mol_type = other RNA
accagcctctgcctcatgatgatgctgcccgccaccctggccttccacctcacgagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgggacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggcccggaacaagcccaccctggacatcgagctgcagaagaccgaggccacccagctcgcgacgctgcgcaagctgtgcatcgagggcaagatcaccaacatcaccaccgacagccggtgccccacgcagggcgaggccatcctcccggaggagcaggaccagaactacgtgtgcaagcacacctacgtcgaccgcgggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcggaccggcctggacttcaacgagatgatcctcctgaccatgaagaacaaggcgtggatggtccaccgccagtggttcttcgacctgcccctcccctggacgagcggcgccaccaccgagacccccacgtggaaccggaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccgcctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccggctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccgcggcgcccggcgcatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccggagcaccacccgcatggagaacctcctgtggaagcagatcgcgaacgagctgaactacatcctctgggagaacaacatcaagctgacggtggtcgtgggggacatcatcggcgtgctggagcagggcaagcggaccctcacgccccagccgatggagctgaagtactcctggaagacctgggggaaggccaagatcgtcacggccgagacccagaacagctccttcatcatcgacggccccaacacccccgagtgccccagcgcctcccgcgcgtggaacgtgtgggaggtggaggactacgggttcggcgtcttcaccacgaacatctggctgaagctccgggaggtgtacacccagagctgcgaccaccgcctgatgagcgccgccatcaaggacgagcgggccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccgcccgggctaccacacgcagaccgccgggccctggcacctcggcaagctggagctggacttcaactactgcgagggcaccaccgtggtcatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtctccgccggcagcgggaaggtggacaacttcaccatgggcgtgctgtgcctcgccatcctgttcgaggaggtcatgcgcgggaagttcggcaagaagcacatgatcgcgggggtgctgttcaccttcgtgctcctgctgtccggccagatcacgtggcgggacatggcccacaccttcatcatgatcggcagcaacgcctccgaccgcatggggatgggcgtcacctacctcgccctgatcgccaccttcaagatccagcccttcctggcgctcgggttcttcctgcggaagctgacgagccgcgagaacctcctgctgggcgtgggcctcgccatggccaccaccctgcagctgcccgaggacatcgagcagatggccaacgggatcgcgctcggcctgatgaccctgaagctcatcacgcagttcgagacctaccagctgtggaccgccctggtgagcctgacctgctccaacacgatcttcaccctgaccgtcgcctggcggaccgccacgctggtgctcgccggggtcagcctgctgccgctctgccagtccagctccatgcgcaagaccgactggctgcccatgaccgtggcggccatgggcgtgccgcccctccccctcttcatcttcagcctgaaggacacccccaagcgccggtcctggcccctgaacgagggggtcatggccgtgggcctcgtgagcatcctggcctccagcctgctccgcaacgacgtccccatggccggcccgctggtggccggcgggctgctcatcgcctgctacgtgatcacggggacctccgccgacctgaccgtcgagaaggccgccgacgtgacctgggaggaggaggcggagcagacgggggtgagccacaacctgatgatcaccgtcgacgacgacgggaccatgcggatcaaggacgacgagaccgagaacatcctcaccgtgctgctgaagacggccctcctgatcgtgtccggcatcttcccctacagcatccccgccaccctgctcgtctggcacacctggcagaagcagacccagcgctccggcgtgctgtgggacgtgcccagcccgcccgagacgcagaaggccgagctggaggagggggtctaccggatcaagcagcagggcatcttcgggaagacccaggtgggcgtgggggtccagaaggagggcgtgttccacaccatgtggcacgtgacccgcggcgccgtcctcacgcacaacgggaagcggctggagcccaactgggcgtccgtgaagaaggacctgatcagctacggcgggggctggcgcctctccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtcgggctgtacggcaacggggtggtgaccaagaacggcgggtacgtctccggcatcgcccagaccaacgccgagcccgacggccccacgcccgagctggaggaggagatgttcaagaagcgcaacctcaccatcatggacctgcacccggggagcggcaagacccggaagtacctgcccgccatcgtgcgcgaggccatcaagcggcgcctccggaccctgatcctggcgcccacgcgcgtggtcgccgccgagatggaggaggccctcaaggggctgcccatccggtaccagaccaccgccaccaagtccgagcacacgggccgcgagatcgtggacctgatgtgccacgcgaccttcaccatgcggctcctgagcccggtgcgcgtccccaactacaacctgatcatcatggacgaggcccacttcaccgaccccgcctccatcgccgcccgggggtacatcagcacgcgcgtgggcatgggcgaggcggccgccatcttcatgaccgccacgcccccggggaccgcggaggccttcccccagtccaacgcccccatccaggacgaggagcgcgacatccccgagcggagctggaactccggcaacgagtggatcacggacttcgtggggaagaccgtctggttcgtgccgagcatcaaggccggcaacgacatcgccaactgcctccgcaagaacgggaagaaggtgatccagctgtcccggaagaccttcgacaccgagtaccagaagacgcgcctgaacgactgggacttcgtcgtgaccaccgacatcagcgagatgggcgcgaacttcaaggccgaccgggtgatcgacccccgccggtgcctcaagcccgtcatcctgaccgacggccccgagcgcgtgatcctggccgggccgatgcccgtgacggccgcctccgcggcccagcggcgcggccgggtcgggcgcaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgggagaagtccgcggccatcgacggcgagtaccgcctgaagggcgagtcccggaagaccttcgtggagctgatgcgccgcggggacctccccgtctggctggcccacaaggtggccagcgagggcatcaagtacacggaccgcaagtggtgcttcgacggggagcggaacaaccagatcctggaggagaacatggacgtggagatctggaccaaggagggcgagcgcaagaagctccgcccgcggtggctggacgcgcgcacctactccgaccccctggccctcaaggagttcaaggacttcgccgccggccgcaagagcatcgccctggacctggtcaccgagatcgggcgcgtgccctcccacctcgcgtaccggacgcgcaacgccctggacaacctggtgatgctccacaccagcgagcacggcgggcgggcctaccgccacgccgtcgaggagctgccggagaccatggagaccctgctcctgctgggcctcatgatcctgctgaccggcggggccatgctgttcctgatcagcgggaaggggatcggcaagacctccatcgggctgatctgcgtgatcgtgagctccggcatgctctggatggcggacgtccccctgcagtggatcgccagcgccatcgtgctggagttcttcatgatggtgctcctgatccccgagcccgagaagcagcggaccccgcaggacaaccagctggcctacgtcgtgatcgggatcctcaccctggccgcgatcgtggccgccaacgagatgggcctgctcgagacgaccaagcgcgacctgggcatgtccaaggagcccggggtcgtgagccccacctcctacctggacgtggacctccaccccgccagcgcctggaccctgtacgcggtcgccacgaccgtgatcaccccgatgctgcggcacaccatcgagaactccacggccaacgtgagcctcgccgcgatcgccaaccaggccgtcgtgctgatgggcctggacaaggggtggcccatctccaagatggacctcggcgcgcccctcctggccctcgggtgctacagccaggtgaaccccctgaccctgaccgcggccgtcctcctgctggtgacccactacgccatcatcggcccgggcctccaggccaaggccacgcgcgaggcgcagaagcggaccgccgccgggatcatgaagaaccccaccgtggacggcatcatgaccatcgacctggaccccgtcatctacgactccaagttcgagaagcagctgggccaggtgatgctcctggtgctgtgcgccgtccagctcctgctgatgcgcacgagctgggccctctgcgaggcgctgaccctggccaccggccccatcaccacgctctgggagggctccccggggaagttctggaacaccaccatcgccgtgagcatggccaacatcttccggggctcctacctggcgggggccggcctggccttcagcatcatgaagtccgtggggaccggccgccggggcacggggagccagggcgagaccctcggggagaagtggaagaagaagctgaaccagctgagccgcaaggagttcgacctctacaagaagtccggcatcaccgaggtcgaccggaccgaggccaaggaggggctgaagcgcggcgagaccacgcaccacgccgtgagccggggctccgcgaagctgcagtggttcgtggagcgcaacatggtcatccccgaggggcgcgtgatcgacctcggctgcgggcggggcgggtggagctactactgcgccggcctgaagaaggtgaccgaggtccgcggctacaccaagggcggccccgggcacgaggagcccgtgccgatgtccacctacggctggaacatcgtgaagctgatgagcgggaaggacgtcttctacctgccgcccgagaagtgcgacacgctgctgtgcgacatcggcgagtccagcccctccccgaccgtggaggagagccggaccatccgcgtgctgaagatggtcgagccctggctcaagaacaaccagttctgcatcaaggtgctgaacccctacatgcccaccgtgatcgagcacctggagcggctccagcgcaagtacggcgggatgctggtccggaacccgctgtcccgcaacagcacgcacgagatgtactggatctccaacggcaccgggaacatcgtgagctccgtgaacatggtcagccggctcctgctgaaccgcttcaccatgacccaccggcgccccacgatcgagaaggacgtggacctcggcgccggcacccggcacgtcaacgccgagcccgagaccccgaacatggacgtgatcggggagcgcatcaagcggatcaaggaggagcactccagcacctggcactacgacgacgagaacccctacaagacgtgggcctaccacggctcctacgaggtgaaggcgaccgggagcgccagctccatgatcaacggcgtcgtgaagctgctgaccaagccctgggacgtggtccccatggtgacccagatggccatgacggacaccaccccgttcgggcagcagcgcgtgttcaaggagaaggtcgacacccggacgccccgccccatgcccggcacccggaaggtgatggagatcaccgccgagtggctctggcgcaccctgggccgcaacaagaagccgcggctgtgcacgcgcgaggagttcaccaagaaggtgcggaccaacgccgcgatgggggccgtcttcaccgaggagaaccagtgggacagcgcccgcgccgcggtggaggacgaggagttctggaagctcgtggaccgggagcgcgagctgcacaagctgggcaagtgcgggtcctgcgtctacaacatgatgggcaagcgggagaagaagctcggggagttcggcaaggccaagggcagccgcgccatctggtacatgtggctgggggcccggtacctggagttcgaggccctcggcttcctgaacgaggaccactggttctcccgcgagaacagctactccggggtggagggcgaggggctgcacaagctcggctacatcctgcgggacatcagcaagatccccggcggggcgatgtacgccgacgacacggccggctgggacacccgcatcaccgaggacgacctgcacaacgaggagaagatcacccagcagatggaccccgagcaccggcagctcgccaacgccatcttcaagctgacgtaccagaacaaggtggtcaaggtgcagcgccccaccccgaaggggaccgtgatggacatcatctcccggaaggaccagcgcggcagcggccaggtcgggacctacggcctgaacaccttcacgaacatggaggcgcagctcgtgcggcagatggagggggagggcgtgctgtccaaggccgacctggagaacccccacctcctggagaagaagatcacccagtggctggagaccaagggggtcgagcgcctcaagcggatggccatcagcggcgacgactgcgtggtgaagcccatcgacgaccgcttcgccaacgccctgctggcgctcaacgacatgggcaaggtccggaaggacatcccccagtggcagccgtccaaggggtggcacgactggcagcaggtccccttctgcagccaccacttccacgagctgatcatgaaggacggccgcaagctggtggtcccctgccgcccccaggacgagctcatcgggcgggcccgcatctcccagggcgccgggtggagcctgaaggagaccgcctgcctgggcaaggcctacgcgcagatgtggtccctcatgtacttccaccggcgcgacctgcggctggccagcaacgccatctgctccgccgtgccggtgcactggatccccatcagccgcacgacctggagcatccacgcgcaccaccagtggatgaccaccgaggacatgctcacggtctggaaccgggtgtggatcgaggacaacccctggatggaggacaagacccccgtgaccacctgggaggacgtcccgtacctgggcaagcgcgaggaccagtggtgcgggtccctgatcggcctcacgagccgggccacctgggcccagaacatcctgaccgccatccagcaggtccgctccctgatcggggacgaggagttcctcgactacatgcccagcatgaagcggttccgcaaggaggaggagtccgagggcgccatctggtga

SEQ ID NO: 10307 - RNA, 9873 nt, synthetic construct
  misc_feature 1..9873: note = derived and/or modified CDS sequence (opt1) from DENV-3__EU660411__SS-prME
  source 1..9873: mol_type = other RNA
accagcctgtgcctcatgatgatgctgcccgccaccctggccttccacctcaccagccgggacggggagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtactcctggaagacctgggggaaggcgaagatcgtgacggccgagacccagaacagctccttcatcatcgacggccccaacacccccgagtgccccagcgcctcccgggcctggaacgtgtgggaggtcgaggactacgggttcggcgtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacaccctctggtccaacggcgtgctggagagcgacatgatcatccccaagtccctggcggggcccatcagccagcacaaccaccggccgggctaccacacgcagaccgccgggccctggcacctcggcaagctggagctggacttcaactactgcgagggcaccaccgtcgtgatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcaccttcgtcctcctgctgtccggccagatcacgtggcgcgacatggcgcacaccctcatcatgatcggcagcaacgcctccgaccggatggggatgggcgtgacctacctggccctgatcgccaccttcaagatccagcccttcctcgccctggggttcttcctgcgcaagctcacgagccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggccgcgatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcacggggacctccgccgacctgaccgtcgagaaggccgccgacgtgacctgggaggaggaggccgagcagacgggcgtgagccacaacctcatgatcaccgtcgacgacgacgggaccatgcgcatcaaggacgacgagaccgagaacatcctgaccgtgctgctcaagacggcgctgctgatcgtgtccggcatcttcccctacagcatccccgccaccctcctggtctggcacacctggcagaagcagacccagcggtccggcgtgctgtgggacgtgcccagcccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggcctccgtgaagaaggacctcatcagctacggcgggggctggcggctgtccgcgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggaccagcggcagcccgatcatcaaccgcgagggcaagatcgtggggctgtacggcaacggggtcgtgaccaagaacggcgggtacgtgtccggcatcgcgcagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcccccacgcgggtggtggcggccgagatggaggaggccctgaaggggctgcccatccgctaccagaccaccgccatcaagtccgagcacaccggccgggagatcgtcgacctcatgtgccacgccacgttcaccatgcgcctgctgagcccggtgcgggtgcccaactacaacctcatcatcatggacgaggcgcacttcaccgaccccgcctccatcgccgcccgcgggtacatcagcacccgggtcggcatgggcgaggccgcggccatcttcatgacggccacgccgcccgggaccgccgaggcgttcccccagtccaacgcccccatccaggacgaggagcgcgacatccccgagcgcagctggaactccggcaacgagtggatcaccgacttcgtggggaagacggtgtggttcgtccccagcatcaaggccggcaacgacatcgccaactgcctgcggaagaacgggaagaaggtgatccagctgtcccgcaagaccttcgacaccgagtaccagaagacccggctcaacgactgggacttcgtggtcacgaccgacatcagcgagatgggcgccaacttcaaggcggaccgcgtgatcgacccccggcgctgcctgaagcccgtgatcctgaccgacggccccgagcgggtcatcctcgccgggccgatgcccgtgaccgccgcctccgccgcgcagcgccggggccgcgtggggcggaacccccagaaggagaacgaccagtacatcttcacgggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagaccttcgtcgagctcatgcggcgcggggacctgcccgtgtggctggcccacaaggtcgccagcgagggcatcaagtacaccgaccggaagtggtgcttcgacggggagcgcaacaaccagatcctcgaggagaacatggacgtggagatctggacgaaggagggcgagcggaagaagctgcgcccgcgctggctggacgcccggacctactccgaccccctcgcgctgaaggagttcaaggacttcgccgccggccgcaagagcatcgccctggacctcgtgaccgagatcgggcgggtcccctcccacctggcctaccgcacccggaacgcgctggacaacctcgtgatgctgcacacgagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacgtccatcgggctcatctgcgtcatcgtgagctccggcatgctgtggatggccgacgtgcccctgcagtggatcgcgagcgccatcgtcctcgagttcttcatgatggtgctgctgatccccgagcccgagaagcagcgcaccccgcaggacaaccagctcgcctacgtggtcatcgggatcctgaccctggccgccatcgtggcggccaacgagatgggcctcctggagaccacgaagcgggacctgggcatgtccaaggagcccggggtggtcagccccacctcctacctcgacgtggacctgcaccccgccagcgcctggaccctgtacgccgtggcgaccacggtcatcaccccgatgctccgccacaccatcgagaactccaccgccaacgtgagcctggccgccatcgcgaaccaggccgtggtcctgatgggcctcgacaaggggtggcccatctccaagatggacctgggcgtgcccctgctcgccctggggtgctacagccaggtgaaccccctgacgctcaccgccgccgtcctgctgctcgtgacccactacgcgatcatcggcccgggcctgcaggccaaggccacccgggaggcccagaagcgcacggccgcggggatcatgaagaaccccaccgtggacggcatcatgaccatcgacctggaccccgtcatctacgactccaagttcgagaagcagctcggccaggtgatgctgctggtgctctgcgccgtccagctgctgctcatgcggaccagctgggccctgtgcgaggccctgacgctcgccaccggccccatcaccaccctgtgggagggctccccggggaagttctggaacacgaccatcgcggtgagcatggccaacatcttccgcggctcctacctggccggggccggcctcgcgttcagcatcatgaagtccgtggggaccggccggcgcggcaccgggagccagggcgagacgctgggggagaagtggaagaagaagctgaaccagctcagccggaaggagttcgacctgtacaagaagtccggcatcaccgaggtcgaccgcaccgaggccaaggaggggctgaagcggggcgagaccacccaccacgccgtgagccgcggctccgccaagctccagtggttcgtggagcggaacatggtcatccccgaggggcgcgtgatcgacctgggctgcgggcgcggcgggtggagctactactgcgccggcctgaagaaggtgacggaggtccggggctacaccaagggcgggcccgggcacgaggagcccgtgccgatgtccacctacggctggaacatcgtgaagctcatgagcgggaaggacgtcttctacctgccgcccgagaagtgcgacaccctgctgtgcgacatcggcgagtccagcccctccccgacggtggaggagagccgcaccatccgggtgctcaagatggtcgagccctggctgaagaacaaccagttctgcatcaaggtgctgaacccctacatgcccaccgtgatcgagcacctcgagcgcctgcagcggaagtacggcgggatgctggtccgcaacccgctctcccggaacagcacccacgagatgtactggatctccaacggcacggggaacatcgtgagctccgtgaacatggtcagccgcctgctgctcaaccggttcaccatgacccaccgccggcccaccatcgagaaggacgtggacctgggcgcgggcacgcgccacgtcaacgccgagcccgagaccccgaacatggacgtgatcggggagcggatcaagcgcatcaaggaggagcactccagcacctggcactacgacgacgagaacccctacaagacctgggcctaccacggctcctacgaggtgaaggccacggggagcgccagctccatgatcaacggcgtcgtgaagctgctcaccaagccctgggacgtggtccccatggtgacccagatggcgatgaccgacacgaccccgttcgggcagcagcgggtgttcaaggagaaggtcgacacccgcacgccccggcccatgcccggcacgcgcaaggtgatggagatcaccgccgagtggctgtggcggaccctgggccgcaacaagaagccgcgcctctgcacccgggaggagttcacgaagaaggtgcgcaccaacgccgccatgggggccgtcttcaccgaggagaaccagtgggacagcgcgcgggccgccgtggaggacgaggagttctggaagctggtggaccgcgagcgggagctgcacaagctcggcaagtgcgggtcctgcgtctacaacatgatgggcaagcgcgagaagaagctgggggagttcggcaaggccaagggcagccgggcgatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgccgacgacaccgcgggctgggacacgcggatcaccgaggacgacctccacaacgaggagaagatcacccagcagatggaccccgagcaccgccagctggccaacgccatcttcaagctgacctaccagaacaaggtggtcaaggtgcagcggcccacgccgaaggggaccgtgatggacatcatctcccgcaaggaccagcggggcagcggccaggtcgggacctacggcctcaacaccttcaccaacatggaggcccagctggtgcgccagatggagggggagggcgtgctgtccaaggccgacctcgagaacccccacctcctggagaagaagatcacgcagtggctcgagaccaagggggtcgagcggctgaagcgcatggcgatcagcggcgacgactgcgtggtgaagcccatcgacgaccggttcgccaacgccctgctcgccctgaacgacatgggcaaggtccgcaaggacatcccccagtggcagccgtccaaggggtggcacgactggcagcaggtccccttctgcagccaccacttccacgagctgatcatgaaggacggccggaagctcgtggtcccctgccgcccccaggacgagctgatcgggcgcgcccggatctcccagggcgcggggtggagcctgaaggagaccgcctgcctcggcaaggcctacgcccagatgtggtccctgatgtacttccaccgccgggacctgcgcctcgccagcaacgcgatctgctccgccgtgccggtgcactggatccccaccagccggacgacctggagcatccacgcccaccaccagtggatgaccaccgaggacatgctgacggtctggaaccgcgtgtggatcgaggacaacccctggatggaggacaagacccccgtgaccacctgggaggacgtcccgtacctgggcaagcgggaggaccagtggtgcgggtccctcatcggcctgacgagccgcgccacctgggcgcagaacatcctgaccgccatccagcaggtccggtccctcatcggggacgaggagttcctggactacatgcccagcatgaagcgcttccggaaggaggaggagtccgagggcgccatctggtga

SEQ ID NO: 10308 - RNA, 9873 nt, synthetic construct
  misc_feature 1..9873: note = derived and/or modified CDS sequence (opt1) from DENV-3__FJ432722__SS-prME
  source 1..9873: mol_type = other RNA
accagcctgtgcctcatgatgatgctgcccgccaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgggacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtactcctggaagacctgggggaaggcgaagatcgtgacggccgagacccagaacagctccttcatcatcgacggccccaacacccccgagtgccccagcgcctcccgggcctggaacgtgtgggaggtcgaggactacgggttcggcgtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacaccctctggtccaacggcgtgctggagagcgacatgatcatccccaagtccctggcggggcccatcagccagcacaaccaccggccgggctaccacacgcagaccgccgggccctggcacctcggcaagctggagctggacttcaactactgcgagggcaccaccgtcgtgatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcaccttcgtcctcctgctgtccggccagatcacgtggcgcgacatggcgcacaccctcatcatgatcggcagcaacgcctccgaccggatggggatgggcgtgacctacctggccctgatcgccaccttcaagatccagcccttcctcgccctggggttcttcctgcgcaagctcacgagccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggccgcgatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcacggggacctccgccgacctgaccgtcgagaaggccgccgacgtgacctgggaggaggaggccgagcagacgggcgtgagccacaacctcatgatcaccgtcgacgacgacgggaccatgcgcatcaaggacgacgagaccgagaacatcctgaccgtgctgctcaagacggcgctgctgatcgtgtccggcatcttcccctacagcatccccgccaccctcctggtctggcacacctggcagaagcagacccagcggtccggcgtgctgtgggacgtgcccagcccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggcctccgtgaagaaggacctcatcagctacggcgggggctggcggctgtccgcgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggaccagcggcagcccgatcatcaaccgcgagggcaaggtggtcgggctgtacggcaacggggtggtgaccaagaacggcgggtacgtctccggcatcgcgcagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagtccgagcacacgggccgggagatcgtggacctcatgtgccacgccaccttcaccatgcgcctgctgagcccggtgcgggtccccaactacaacctcatcatcatggacgaggcgcacttcaccgaccccgcctccatcgccgcccgcgggtacatcagcacgcgggtgggcatgggcgaggccgcggccatcttcatgaccgccacgccgcccgggaccgccgaggcgttcccccagtccaacgcccccatccaggacgaggagcgcgacatccccgagcgcagctggaactccggcaacgagtggatcacggacttcgtggggaagaccgtctggttcgtgcccagcatcaaggccggcaacgacatcgccaactgcctgcggaagaacgggaagaaggtgatccagctgtcccgcaagaccttcgacaccgagtaccagaagacgaagctcaacgactgggacttcgtcgtgaccaccgacatcagcgagatgggcgccaacttcaaggcggaccgggtgatcgacccccgccggtgcctgaagcccgtcatcctgaccgacggccccgagcgcgtgatcctcgccgggccgatgcccgtgacggccgcctccgccgcgcagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagtcccggaagaccttcgtggagctcatgcgccgcggggacctgcccgtctggctggcccacaaggtggccagcgagggcatcaagtacacggaccgcaagtggtgcttcgacggggagcggaacaaccagatcctcgaggagaacatggacgtggagatctggaccaaggagggcgagcgcaagaagctgcggccgcgctggctggacgcccgcacctactccgaccccctcgcgctgaaggagttcaaggacttcgccgccggccgcaagagcatcgccctggacctcgtcaccgagatcgggcgcgtgccctcccacctggcctaccggacgcgcaacgcgctggacaacctcgtgatgctgcacaccagcgagcacggcgggcgggcctaccgccacgccgtcgaggagctgccggagaccatggagaccctcctgctgctcggcctgatgatcctgctcaccggcggggccatgctgttcctgatcagcgggaaggggatcggcaagacctccatcgggctcatctgcgtgatcgtgagctccggcatgctgtggatggccgacgtccccctgcagtggatcgcgagcgccatcgtgctcgagttcttcatgatggtgctgctgatccccgagcccgagaagcagcggaccccgcaggacaaccagctcgcctacgtcgtgatcgggatcctgaccctggccgccatcgtggcggccaacgagatgggcctcctggagacgaccaagcgcgacctgggcatgtccaaggagcccggggtcgtgagccccacctcctacctcgacgtggacctgcaccccgccagcgcctggaccctgtacgccgtcgcgacgaccgtgatcaccccgatgctccggcacaccatcgagaactccacggccaacgtgagcctggccgccatcgcgaaccaggccgtcgtgctgatgggcctcgacaaggggtggcccatctccaagatggacctgggcgtgcccctgctcgccctggggtgctacagccaggtcaaccccctgaccctcaccgccgccgtgctgctgctcgtgacccactacgcgatcatcggcccgggcctgcaggccaaggccacgcgcgaggcccagaagcggaccgccgcggggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcgcacgagctgggccctgtgcgaggccctgaccctcgccaccggccccatcaccacgctgtgggagggctccccggggaagttctggaacaccaccatcgcggtgagcatggccaacatcttccggggctcctacctggccggggccggcctcgcgttcagcatcatgaagtccgtcgggaccggccgccggggcacggggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagaccacgcaccacgccgtgagccggggctccgccaagctccagtggttcgtcgagcgcaacatggtgatccccgaggggcgggtgatcgacctgggctgcgggcgcggcgggtggagctactactgcgccggcctgaagaaggtcaccgaggtgcgcggctacaccaagggcgggcccgggcacgaggagcccgtgccgatgtccacctacggctggaacatcgtcaagctcatgagcgggaaggacgtgttctacctgccgcccgagaagtgcgacacgctgctgtgcgacatcggcgagtccagcccctccccgaccgtggaggagagccggaccatccgcgtcctcaagatggtggagccctggctgaagaacaaccagttctgcatcaaggtgctgaacccctacatgcccaccgtcatcgagcacctcgagcggctgcagcgcaagtacggcgggatgctggtgcggaacccgctctcccgcaacagcacgcacgagatgtactggatctccaacggcaccgggaacatcgtgagctccgtcaacatggtgagccggctgctgctcaaccgcttcaccatgacccaccggcgccccacgatcgagaaggacgtcgacctgggcgcgggcacccggcacgtgaacgccgagcccgagaccccgaacatggacgtgatcggggagcgcatcaagcggatcaaggaggagcactccagcacctggcactacgacgacgagaacccctacaagacgtgggcctaccacggctcctacgaggtcaaggccaccgggagcgccagctccatgatcaacggcgtggtgaagctgctcaccaagccctgggacgtcgtgcccatggtgacccagatggcgatgacggacaccaccccgttcgggcagcagcgcgtcttcaaggagaaggtggacacccggacgccccgccccatgcccggcacccggaaggtgatggagatcaccgccgagtggctgtggcgcaccctgggccggaacaagaagccgcgcctctgcacgcgcgaggagttcaccaagaaggtccggaccaacgccgccatgggggccgtgttcaccgaggagaaccagtgggacagcgcgcgcgccgccgtggaggacgaggagttctggaagctggtcgaccgggagcgcgagctgcacaagctcggcaagtgcgggtcctgcgtgtacaacatgatgggcaagcgggagaagaagctgggggagttcggcaaggccaagggcagccgcgcgatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgccgacgacacggcgggctgggacacccgcatcaccgaggacgacctccacaacgaggagaagatcacccagcagatggaccccgagcaccggcagctggccaacgccatcttcaagctgacgtaccagaacaaggtcgtgaaggtgcagcgccccaccccgaaggggaccgtcatggacatcatctcccggaaggaccagcgcggcagcggccaggtggggacctacggcctcaacaccttcacgaacatggaggcccagctggtgcggcagatggagggggagggcgtcctgtccaaggccgacctcgagaacccccacctcctggagaagaagatcacccagtggctcgagaccaagggggtggagcgcctgaagcggatggcgatcagcggcgacgactgcgtggtcaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtcgtgccctgccggccccaggacgagctgatcgggcgcgcccgcatctcccagggcgcggggtggagcctgaaggagaccgcctgcctcggcaaggcctacgcccagatgtggtccctgatgtacttccaccggcgcgacctgcggctcgccagcaacgcgatctgctccgccgtgccggtccactggatccccacgagccgcaccacctggagcatccacgcccaccaccagtggatgaccacggaggacatgctgaccgtgtggaaccgggtgtggatcgaggacaacccctggatggaggacaagacccccgtcaccacgtgggaggacgtgccgtacctgggcaagcgcgaggaccagtggtgcgggtccctcatcggcctgaccagccgggccacctgggcgcagaacatcctgaccgccatccagcaggtccgctccctcatcggggacgaggagttcctggactacatgcccagcatgaagcggttccgcaaggaggaggagtccgagggcgtcatctggtga

SEQ ID NO: 10309 - RNA, 9873 nt, synthetic construct
  misc_feature 1..9873: note = derived and/or modified CDS sequence (opt1) from DENV-3__FJ432728__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtgacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggaggactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccggtgcgggtgcccaactacaacctcatcatcatggacgaggcccacttcaccgaccccgcctccatcgccgcccgcgggtacatcagcacgcgggtcggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtggggaagaccgtgtggttcgtccccagcatcaaggccggcaacgacatcgccaactgcctgcggaagaacgggaagaaggtgatccagctgtcccgcaagaccttcgacaccgagtaccagaagacgcggctcaacgactgggacttcgtggtcaccaccgacatcagcgagatgggcgcgaacttcaaggccgaccgcgtgatcgacccccggcgctgcctgaagcccgtgatcctgaccgacggccccgagcgggtcatcctcgccgggccgatgcccgtgacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgtaccgcacgcggaacgccctggacaacctcgtgatgctgcacaccagcgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtcatcgtgagctccggcatgctgtggatggcggacgtgcccctgcagtggatcgccagcgccatcgtcctcgagttcttcatgatggtgctgctgatccccgagcccgagaagcagcgcaccccgcaggacaaccagctcgcctacgtggtcatcgggatcctgaccctggccgcgatcgtggccgccaacgagatgggcctcctggagacgaccaagcgggacctgggcatgtccaaggagcccggggtggtcagccccacctcctacctcgacgtggacctgcaccccgccagcgcctggaccctgtacgcggtggccacgaccgtcatcaccccgatgctccgccacaccatcgagaactccacggccaacgtgagcctggccgcgatcgccaaccaggccgtggtcctgatgggcctcgacaaggggtggcccatctccaagatggacctgggcgtgcccctgctcgccctggggtgctacagccaggtgaaccccctgaccctcaccgccgcggtcctgctgctcgtgacccactacgccatcatcggcccgggcctgcaggccaaggccacgcgggaggcccagaagcgcaccgcggccgggatcatgaagaaccccaccgtggacggcatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgcgaccggccccatcaccacgctgtgggagggctccccggggaagttctggaacaccaccatcgccgtgagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtcgaccgcaccgaggccaaggaggggctgaagcggggcgagaccacgcaccacgccgtgagccgcggctccgccaagctccagtggttcgtggagcggaacatggtcatccccgaggggcgcgtgatcgacctgggctgcgggcgcggcgggtggagctactactgcgcgggcctgaagaaggtgaccgaggtccggggctacaccaagggcggccccgggcacgaggagcccgtgccgatgtccacctacggctggaacctcgtgaagctgatgagcgggaaggacgtcttctacctgccgcccgagaagtgcgacacgctgctctgcgacatcggcgagtccagcccctccccgaccgtggaggagagccgcaccatccgggtgctgaagatggtcgagccctggctgaagaacaaccagttctgcatcaaggtgctcaacccctacatgcccaccgtgatcgagcacctggagcgcctgcagcggaagtacggcgggatgctcgtccgcaacccgctgtcccggaacagcacgcacgagatgtactggatctccaacggcaccgggaacatcgtgagctccgtgaacatggtcagccgcctgctcctgaaccggttcaccatgacccaccgccggcccacgatcgagaaggacgtggacctgggcgccggcacccgccacgtcaacgccgagcccgagaccccgaacatggacgtgatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtcgtgaagctcctgaccaagccctgggacgtggtccccatggtgacccagatggccatgacggacaccaccccgttcgggcagcagcgggtgttcaaggagaaggtcgacacccgcacgccccggcccatgcccggcacccgcaaggtgatggagatcaccgccgagtggctgtggcggaccctcggccgcaacaagaagccgcgcctgtgcacgcgggaggagttcaccaagaaggtgcgcaccaacgccgccatgggggcggtcttcaccgaggagaaccagtgggacagcgcccgggccgccgtggaggacgaggagttctggaagctggtggaccgcgagcgggagctccacaagctgggcaagtgcgggtcctgcgtctacaacatgatgggcaagcgcgagaagaagctgggggagttcggcaaggcgaagggcagccgggccatctggtacatgtggctcggggcccgctacctggagttcgaggccctgggcttcctcaacgaggaccactggttctcccgggagaacagctactccggggtggagggcgaggggctgcacaagctgggctacatcctccgcgacatcagcaagatccccggcggggccatgtacgcggacgacacggccggctgggacacccggatcaccgaggacgacctgcacaacgaggagaagatcacccagcagatggaccccgagcaccgccagctggccaacgccatcttcaagctcacgtaccagaacaaggtggtcaaggtgcagcggcccaccccgaaggggaccgtgatggacatcatctcccgcaaggaccagcggggcagcggccaggtcgggacctacggcctgaacaccttcacgaacatggaggcccagctggtgcgccagatggagggggagggcgtgctctccaaggcggacctggagaacccccacctcctcgagaagaagatcacccagtggctggagaccaagggggtcgagcggctgaagcgcatggccatcagcggcgacgactgcgtggtgaagcccatcgacgaccggttcgccaacgccctcctggccctgaacgacatgggcaaggtccgcaaggacatcccccagtggcagccgtccaaggggtggcacgactggcagcaggtccccttctgcagccaccacttccacgagctcatcatgaaggacggccggaagctggtggtcccctgccgcccccaggacgagctgatcgggcgcgcgcggatctcccagggcgccgggtggagcctcaaggagaccgcctgcctgggcaaggcctacgcccagatgtggtccctgatgtacttccaccgccgggacctccgcctggcgagcaacgccatctgctccgccgtgccggtgcactggatccccacgagccggaccacctggagcatccacgcccaccaccagtggatgaccacggaggacatgctgaccgtctggaaccgcgtgtggatcgaggacaacccctggatggaggacaagacccccgtgaccacgtgggaggacgtcccgtacctcggcaagcgggaggaccagtggtgcgggtccctgatcggcctgaccagccgcgcgacctgggcccagaacatcctcaccgccatccagcaggtccggtccctgatcggggacgaggagttcctggactacatgcccagcatgaagcgcttccggaaggaggaggagtccgagggcgccatctggtga

SEQ ID NO: 10310 - RNA, 9873 nt, synthetic construct
  misc_feature 1..9873: note = derived and/or modified CDS sequence (opt1) from DENV-3__FJ432731__SS-prME
  source 1..9873: mol_type = other RNA
accagcctgtgcctcatgatgatgctgcccgccaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcatgttcgtgctcctgctgtccggccagatcacctggcgcgacatggcccagacgctcatcatgatcggcagcaacgcctccgaccggatggggatgggcgtcacctacctggccctgatcgccaccttcaagatccagcccttcctcgcgctggggttcttcctgcgcaagctcaccagccgggagaacctgctgctcggcgtgggcctggccatgacgaccaccctgcagctccccgaggacatcgagcagatggccaacgggatcgccctgggcctgatgaccctcaagctgatcacgcagttcgagacctaccagctgtggaccgcgctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgccgcgatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccgggggcctcctgatcgcgtgctacgtgatcacggggacctccgccgacctgaccgtggagaaggccgccgacgtcacctgggaggaggaggccgagcagacgggcgtgagccacaacctcatgatcaccgtggacgacgacgggaccatgcgcatcaaggacgacgagaccgagaacatcctgaccgtcctgctcaagacggcgctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcctccgtcaagaaggacctcatcagctacggcgggggctggcggctgtccgcgcagtggcagaagggggaggaggtccaggtgatcgccgtcgagcccggcaagaacccgaagaacttccagaccatgcccggcatcttccagaccaccacgggggagatcggcgccatcgccctggacttcaagcccgggaccagcggcagcccgatcatcaaccgcgagggcaaggtggtggggctgtacggcaacggggtcgtgaccaagaacggcgggtacgtgtccggcatcgcgcagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcccccacgcgggtggtggcggccgagatggaggaggccctgaaggggctgcccatccgctaccagaccaccgccaccaagtccgagcacacgggccgggagatcgtcgacctcatgtgccacgccaccttcaccatgcgcctgctgagcccggtgcgggtgcccaactacaacctcatcatcatggacgaggcgcacttcaccgaccccgcctccatcgccgcccgcgggtacatcagcacgcgggtcggcatgggcgaggccgcggccatcttcatgaccgccacgccgcccgggaccgccgaggcgttcccccagtccaacgcccccatccaggacgaggagcgcgacatccccgagcgcagctggaactccggcaacgagtggatcacggacttcgtggggaagaccgtgtggttcgtccccagcatcaaggccggcaacgacatcgccaactgcctgcggaagaacgggaagaaggtgatccagctgtcccgcaagaccttcgacaccgagtaccagaagacgcggctcaacgactgggacttcgtggtcaccaccgacatcagcgagatgggcgccaacttcaaggcggaccgcgtgatcgacccccggcgctgcctgaagcccgtgatcctgaccgacggccccgagcgggtcatcctcgccgggccgatgcccgtgacggccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcccggacctactccgaccccctcgcgctgaaggagttcaaggacttcgccgccggccgcaagagcatcgccctggacctcgtgaccgagatcgggcgggtcccctcccacctggcctaccgcacgcggaacgcgctggacaacctcgtgatgctgcacaccagcgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtcatcgtgagctccggcatgctgtggatggccgacgtgcccctgcagtggatcgcgagcgccatcatcctcgagttcttcatgatggtcctgctgatccccgagcccgagaagcagcgcaccccgcaggacaaccagctcgcctacgtggtgatcgggatcctgaccctggccgccatcgtcgcggccaacgagatgggcctcctggagacgaccaagcgggacctgggcatgtccaaggagcccggggtggtgagccccacctcctacctcgacgtcgacctgcaccccgccagcgcctggaccctgtacgccgtggcgacgaccgtgatcaccccgatgctccgccacaccatcgagaactccacggccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacccactacgcgatcatcggcccgggcctgcaggccaaggccacgcgggaggcccagaagcgcaccgccgcggggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgccaccggccccatcaccacgctgtgggagggctccccggggaagttctggaacaccaccatcgcggtcagcatggccaacatcttccgcggctcctacctggccggggccggcctcgcgttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtcagccgcggctccgccaagctccagtggttcgtggagcggaacatggtgatccccgaggggcgcgtcatcgacctgggctgcgggcgcggcgggtggagctactactgcgccggcctgaagaaggtgaccgaggtgcggggctacaccaagggcggccccgggcacgaggagcccgtcccgatgtccacctacggctggaacctcgtgaagctgatgagcgggaaggacgtgttctacctgccgcccgagaagtgcgacacgctgctctgcgacatcggcgagtccagcccctccccgaccgtcgaggagagccgcaccatccgggtgctgaagatggtggagccctggctgaagaacaaccagttctgcatcaaggtcctcaacccctacatgcccaccgtgatcgagcacctggagcgcctgcagcggaagtacggcgggatgctcgtgcgcaacccgctgtcccggaacagcacgcacgagatgtactggatctccaacggcaccgggaacatcgtcagctccgtgaacatggtgagccgcctgctcctgaaccggttcaccatgacccaccgccggcccacgatcgagaaggacgtcgacctgggcgcgggcacccgccacgtgaacgccgagcccgagaccccgaacatggacgtcatcggggagcggatcaagcgcatcaaggaggagcactccagcacctggcactacgacgacgagaacccctacaagacgtgggcctaccacggctcctacgaggtgaaggccaccgggagcgccagctccatgatcaacggcgtggtcaagctcctgaccaagccctgggacgtggtgcccatggtcacccagatggcgatgacggacaccaccccgttcgggcagcagcgggtgttcaaggagaaggtggacacccgcacgccccggcccatgcccggcacccgcaaggtcatggagatcaccgccgagtggctgtggcggaccctcggccgcaacaagaagccgcgcctgtgcacgcgggaggagttcaccaagaaggtgcgcaccaacgccgccatgggggccgtgttcaccgaggagaaccagtgggacagcgcgcgggccgccgtcgaggacgaggagttctggaagctggtggaccgcgagcgggagctccacaagctgggcaagtgcgggtcctgcgtgtacaacatgatgggcaagcgcgagaagaagctgggggagttcggcaaggccaagggcagccgggcgatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggccatgtacgccgacgacacggcgggctgggacacccggatcaccgaggacgacctgcacaacgaggagaagatcacccagcagatggaccccgagcaccgccagctggccaacgccatcttcaagctcacgtaccagaacaaggtggtgaaggtccagcggcccaccccgaaggggaccgtgatggacatcatctcccgcaaggaccagcggggcagcggccaggtggggacctacggcctgaacaccttcacgaacatggaggcccagctggtccgccagatggagggggagggcgtgctctccaaggccgacctggagaacccccacctcctcgagaagaagatcacccagtggctggagaccaagggggtggagcggctgaagcgcatggcgatcagcggcgacgactgcgtcgtgaagcccatcgacgaccggttcgccaacgccctcctggccctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcccggatctcccagggcgcggggtggagcctcaaggagaccgcctgcctgggcaaggcctacgcccagatgtggtccctgatgtacttccaccgccgggacctccgcctggccagcaacgcgatctgctccgccgtcccggtgcactggatccccacgagccggaccacctggagcatccacgcccaccaccagtggatgaccacggaggacatgctgaccgtgtggaaccgcgtctggatcgaggacaacccctggatggaggacaagacccccgtgaccacgtgggaggacgtgccgtacctcggcaagcgggaggaccagtggtgcgggtccctgatcggcctgaccagccgcgccacctgggcgcagaacatcctcaccgccatccagcaggtccggtccctgatcggggacgaggagttcctggactacatgcccagcatgaagcgcttccggaaggaggaggagtccgagggcgccatctggtga

SEQ ID NO: 10311 - RNA, 9873 nt, synthetic construct
  misc_feature 1..9873: note = derived and/or modified CDS sequence (opt1) from DENV-3__FJ562097__SS-prME
  source 1..9873: mol_type = other RNA
accagcctgtgcctcatgatgatgctgcccgcgaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtactcctggaagacctgggggaaggcgaagatcgtgacggccgagacccagaacagctccttcatcatcgacggccccaacacccccgagtgccccagcgcctcccgggcctggaacgtgtgggaggtcgaggactacgggttcggcgtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacaccctctggtccaacggcgtgctggagagcgacatgatcatccccaagtccctggcggggcccatcagccagcacaaccaccggccgggctaccacacgcagaccgccgggccctggcacctcggcaagctggagctggacttcaactactgcgagggcaccaccgtcgtgatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcaccttcgtcctcctgctgtccggccagatcacgtggcgcgacatggcgcacaccctcatcatgatcggcagcaacgcctccgaccggatggggatgggcgtgacctacctggccctgatcgccaccttcaagatccagcccttcctcgccctggggttcttcctgcgcaagctcacgagccgggagaacctgctgctcggcgtgggcctggcgatggccgccaccctgcagctccccgaggacatcgagcagatggccaacgggatcgcgctgggcctgatgaccctcaagctgatcacccagttcgagacgtaccagctgtggaccgccctcgtcagcctgacctgctccaacaccatcttcacgctgaccgtggcctggcgcaccgccaccctcatcctggccggggtcagcctgctcccgctgtgccagtccagctccatgcggaagacggactggctgcccatgaccgtggcggccatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccggcgggctcctgatcgcctgctacgtgatcaccgggacgtccgccgacctgaccgtcgagaaggccgccgacgtgacctgggaggaggaggcggagcagaccggggtgagccacaacctcatgatcacggtcgacgacgacgggaccatgcgcatcaaggacgacgagaccgagaacatcctgaccgtgctgctcaagaccgccctgctgatcgtgtccggcgtcttcccctacagcatccccgccacgctcctggtgtggcacacctggcagaagcagacccagcggtccggcgtgctgtgggacgtccccagcccgcccgagacccagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacccacaacgggaagcgcctggagcccaactgggcgtccgtgaagaaggacctcatcagctacggcgggggctggcggctgtccgcccagtggcagaagggggaggaggtccaggtgatcgccgtggagcccggcaagaacccgaagaacttccagacgatgcccggcatcttccagaccaccaccggggagatcggcgccatcgcgctggacttcaagcccgggacgagcggcagcccgatcatcaaccgcgagggcaaggtcgtggggctgtacggcaacggggtggtcaccaagaacggcgggtacgtgtccggcatcgcccagaccaacgccgagcccgacggccccacccccgagctcgaggaggagatgttcaagaagcggaacctgacgatcatggacctgcacccggggagcggcaagacccgcaagtacctccccgccatcgtgcgggaggccatcaagcgccggctgcgcaccctgatcctcgcgcccacccgggtcgtggccgccgagatggaggaggccctgaaggggctgcccatccgctaccagacgaccgccaccaagtccgagcacaccggccgggagatcgtggacctcatgtgccacgcgacgttcaccatgcgcctgctgagcccggtccgggtgcccaactacaacctcatcatcatggacgaggcccacttcaccgaccccgcctccatcgccgcccgcgggtacatcagcacccgggtgggcatgggcgaggcggccgccatcttcatgacggccacgccgcccgggaccgcggaggccttcccccagtccaacgcccccatccaggacgaggagcgcgacatccccgagcgcagctggaactccggcaacgagtggatcaccgacttcgtcgggaagacggtgtggttcgtgcccagcatcaaggccggcaacgacatcgccaactgcctgcggaagaacgggaagaaggtcatccagctgtcccgcaagaccttcgacaccgagtaccagaagaccaagctcaacgactgggacttcgtggtgacgaccgacatcagcgagatgggcgcgaacttcaaggccgaccgggtcatcgacccccgccggtgcctgaagcccgtgatcctgaccgacggccccgagcgcgtgatcctcgccgggccgatgcccgtcaccgccgcctccgcggcccagcggcgcggccgggtggggcgcaacccccagaaggagaacgaccagtacatcttcacgggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagaccttcgtcgagctcatgcgccgcggggacctgcccgtgtggctggcccacaaggtggccagcgagggcatcaagtacaccgaccgcaagtggtgcttcgacggggagcggaacaaccagatcctcgaggagaacatggacgtcgagatctggacgaaggagggcgagcgcaagaagctgcggccgcgctggctggacgcgcgcacctactccgaccccctcgccctgaaggagttcaaggacttcgccgccggccgcaagagcatcgccctggacctcgtgaccgagatcgggcgcgtgccctcccacctggcgtaccggacccgcaacgccctggacaacctcgtcatgctgcacacgagcgagcacggcgggcgggcctaccgccacgccgtggaggagctgccggagaccatggagaccctcctgctgctcggcctgatgatcctgctcaccgggggcgccatgctgttcctgatcagcggcaaggggatcggcaagacgtccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcggaccccgcaggacaaccagctcgcctacgtggtgatcgggatcctgaccctggccgcgatcgtcgccgccaacgagatgggcctcctggagaccacgaagcgcgacctgggcatgtccaaggagcccggggtggtgagccccacctcctacctcgacgtcgacctgcaccccgccagcgcctggaccctgtacgcggtggccaccacggtgatcaccccgatgctccggcacaccatcgagaactccaccgccaacgtcagcctggccgcgatcgccaaccaggccgtggtgctgatgggcctcgacaaggggtggcccatctccaagatggacctgggcgtccccctgctcgccctggggtgctacagccaggtgaaccccctgacgctcaccgccgcggtgctgctgctcgtcacccactacgccatcatcggcccgggcctgcaggccaaggccacccgcgaggcccagaagcggacggcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcgcaccagctgggccctgtgcgaggccctgacgctcgcgaccggccccatcaccaccctgtgggagggctccccggggaagttctggaacacgaccatcgccgtcagcatggccaacatcttccggggctcctacctggccggggcgggcctcgccttcagcatcatgaagtccgtggggaccggccgccggggcaccgggagccagggcgagacgctgggggagaagtggaagaagaagctgaaccagctcagccgcaaggagttcgacctgtacaagaagtccggcatcaccgaggtggaccggaccgaggccaaggaggggctgaagcgcggcgagaccacccaccacgccgtcagccggggctccgccaagctccagtggttcgtggagcgcaacatggtgatccccgaggggcgggtcatcgacctgggctgcgggcgcggcgggtggagctactactgcgcgggcctgaagaaggtgacggaggtgcgcggctacaccaagggcggccccgggcacgaggagcccgtcccgatgtccacctacggctggaacatcgtgaagctcatgagcgggaaggacgtgttctacctgccgcccgagaagtgcgacaccctgctgtgcgacatcggcgagtccagcccctccccgacggtcgaggagagccggaccatccgcgtgctcaagatggtggagccctggctgaagaacaaccagttctgcatcaaggtcctgaacccctacatgcccaccgtgatcgagcacctcgagcggctgcagcgcaagtacggcgggatgctggtgcggaacccgctctcccgcaacagcacccacgagatgtactggatctccaacggcacggggaacatcgtcagctccgtgaacatggtcagccggctgctgctcaaccgcttcaccatgacccaccggcgccccaccatcgagaaggacgtggacctgggcgccggcacgcggcacgtgaacgccgagcccgagaccccgaacatggacgtcatcggggagcgcatcaagcggatcaaggaggagcactccagcacctggcactacgacgacgagaacccctacaagacctgggcctaccacggctcctacgaggtgaaggccacggggagcgcgagctccatgatcaacggcgtggtcaagctgctcaccaagccctgggacgtggtgcccatggtcacccagatggccatgaccgacacgaccccgttcgggcagcagcgcgtgttcaaggagaaggtggacacccggacgccccggcccatgcccggcacgcggaaggtcatggagatcaccgccgagtggctgtggcgcaccctgggccggaacaagaagccgcgcctctgcacccgcgaggagttcacgaagaaggtgcggaccaacgccgccatgggggcggtgttcaccgaggagaaccagtgggacagcgcccgcgccgccgtcgaggacgaggagttctggaagctggtggaccgggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtcgagggcgaggggctccacaagctgggctacatcctgcgggacatcagcaagatccccggcggggccatgtacgcggacgacaccgccggctgggacacgcgcatcaccgaggacgacctccacaacgaggagaagatcacccagcagatggaccccgagcaccggcagctggccaacgccatcttcaagctgacctaccagaacaaggtggtgaaggtccagcgccccacgccgaaggggaccgtgatggacatcatctcccggaaggaccagcgcggcagcggccaggtggggacctacggcctcaacaccttcaccaacatggaggcccagctggtccggcagatggagggggagggcgtgctgtccaaggcggacctcgagaacccccacctcctggagaagaagatcacgcagtggctcgagaccaagggggtggagcgcctgaagcggatggccatcagcggcgacgactgcgtcgtgaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtggtgccctgccggccccaggacgagctgatcgggcgcgcgcgcatctcccagggcgccgggtggagcctgaaggagaccgcctgcctcggcaaggcctacgcccagatgtggtccctgatgtacttccaccggcgcgacctgcggctcgcgagcaacgccatctgctccgccgtcccggtgcactggatccccaccagccgcacgacctggagcatccacgcccaccaccagtggatgaccaccgaggacatgctgacggtgtggaaccgggtctggatcgaggacaacccctggatggaggacaagacccccgtgaccacctgggaggacgtgccgtacctgggcaagcgcgaggaccagtggtgcgggtccctcatcggcctgacgagccgggcgacctgggcccagaacatcctgaccgccatccagcaggtccgctccctcatcggggacgaggagttcctggactacatgcccagcatgaagcggttccgcaaggaggaggagtccgagggcgccatctggtga

SEQ ID NO: 10312 - RNA, 9873 nt, synthetic construct
  misc_feature 1..9873: note = derived and/or modified CDS sequence (opt1) from DENV-3__FJ432741__SS-prME
  source 1..9873: mol_type = other RNA
accagcctgtgcctcatgatgatgctgcccgccaccctggccttccacctcaccagccgggacggggagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcgccaagaaggaggagcccgtgaacatcgaggccgagccgcccttcggggagagcaacatcgtgatcggcatcggggacaaggcgctcaagatcaactggtacaagaagggctccagcatcgggaagatgttcgaggccaccgcccggggcgcccgccggatggccatcctgggcgacacggcgtgggacttcgggtccgtcggcggggtgctgaacagcctcggcaagatggtgcaccagatcttcgggtccgcctacaccgccctgttcagcggcgtctcctggatcatgaagatcggcatcggggtgctgctcacctggatcggcctgaacagcaagaacacctccatgagcttctcctgcatcgtgatcgggatcatcacgctgtacctcggcgccgtcgtgcaggccgacatggggtgcgcgatcaactggaagggcaaggagctgaagtgcggcagcgggatcttcgtgaccaacgaggtccacacctggaccgagcagtacaagttccaggccgactcccccaagcgcctggccacggccatcgccggcgcgtgggagaacggggtgtgcggcatccgcagcaccacccggatggagaacctcctgtggaagcagatcgccaacgagctgaactacatcctctgggagaacaacatcaagctgaccgtggtcgtgggggacatcatcggcgtgctggagcagggcaagcgcacgctcacgccccagccgatggagctgaagtactcctggaagacctgggggaaggccaagatcgtcaccgccgagacgcagaacagctccttcatcatcgacggccccaacacccccgagtgccccagcgcgtcccgggcctggaacgtgtgggaggtggaggactacgggttcggcgtcttcaccaccaacatctggctgaagctccgcgaggtgcacacgcagagctgcgaccaccggctgatgagcgccgccatcaaggacgagcgcgccgtgcacgcggacatgggctactggatcgagtcccagaagaacgggagctggaagctggagaaggcctccttcatcgaggtcaagacctgcacctggcccaagagccacaccctctggtccaacggcgtgctggagagcgacatggtgatccccaagtccctggccgggcccatcagccagcacaaccaccggccgggctaccacacccagacggccgggccctggcacctcggcaagctggagctggacttcaactactgcgagggcaccaccgtcgtgatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgcgatcctgttcgaggaggtgatgcgggggaagttcggcaagaagcacatgatcgccggggtgctgttcaccttcgtcctcctgctgtccggccagatcacctggcgcgacatggcccacacgctcatcatgatcggcagcaacgcctccgaccggatggggatgggcgtgacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatgaccctcaagctgatcacccagttcgagacgtaccagctgtggaccgccctcgtcagcctgacctgctccaacaccatcttcacgctgaccgtggcctggcgcaccgccaccctcatcctggcgggggtcagcctgctcccgctgtgccagtccagctccatgcggaagacggactggctgcccatgaccgtggccgccatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggcgggcccgctggtggccgggggcctcctgatcgcctgctacgtgatcaccgggacgtccgccgacctgaccgtcgagaaggccgcggacgtgacctgggaggaggaggccgagcagaccggcgtgagccacaacctcatgatcacggtcgacgacgacgggaccatgcgcatcaaggacgacgagaccgagaacatcctgaccgtgctgctcaagaccgccctgctgatcgtgtccggcatcttcccctacagcatccccgccacgctcctggtctggcacacctggcagaagcagacccagcggtccggcgtgctgtgggacgtgcccagcccgcccgagacccagaaggccgagctcgaggagggggtctaccgcatcaagcagcagggcatcttcgggaagacccaggtgggcgtgggggtccagaaggagggcgtgttccacaccatgtggcacgtgacccggggcgcggtcctgacccacaacgggaagcgcctggagcccaactgggcctccgtgaagaaggacctcatcagctacggcgggggctggcggctgtccgcccagtggcagaagggggaggaggtgcaggtcatcgccgtggagcccggcaagaacccgaagaacttccagacgatgcccggcatcttccagaccaccaccggggagatcggcgcgatcgccctggacttcaagcccgggacgagcggcagcccgatcatcaaccgcgagggcaaggtggtcgggctgtacggcaacggggtggtgaccaagaacggcgggtacgtctccggcatcgcccagaccaacgccgagcccgacggccccacccccgagctcgaggaggaggtgttcaagaagcggaacctgacgatcatggacctgcacccggggagcggcaagacccgcaagtacctccccgccatcgtgcgggaggcgatcaagcgccggctgcgcaccctgatcctcgcccccacccgggtcgtggccgccgagatggaggaggccctgaaggggctgcccatccgctaccagacgaccgcgaccaagtccgagcacaccggccgggagatcgtggacctcatgtgccacgccacgttcaccatgcgcctgctgagcccggtccgggtgcccaactacaacctcatcatcatggacgaggcccacttcaccgaccccgcctccatcgccgcgcgcgggtacatcagcacccgggtgggcatgggcgaggccgccgccatcttcatgacggcgacgccgcccgggaccgccgaggccttcccccagtccaacgcccccatccaggacgaggagcgcgacatccccgagcgcagctggaactccggcaacgagtggatcaccgacttcgtcgggaagacggtgtggttcgtgcccagcatcaaggccggcaacgacatcgcgaactgcctgcggaagaacgggaagaaggtcatccagctgtcccgcaagaccttcgacaccgagtaccagaagacccggctcaacgactgggacttcgtggtgacgaccgacatcagcgagatgggcgccaacttcaaggccgaccgcgtcatcgacccccggcgctgcctgaagcccgtgatcctgaccgacggccccgagcgggtgatcctcgccgggccgatgcccgtcaccgccgcgtccgccgcccagcgccggggccgcgtggggcggaacccccagaaggagaacgaccagtacatcttcacgggccagcccctgaacaacgacgaggaccacgcccactggaccgaggccaagatgctgctcgacaacatcaacaccccggaggggatcatccccgcgctgttcgagcccgagcgcgagaagtccgccgccatcgacggcgagtaccggctgaagggcgagtcccgcaagaccttcgtcgagctcatgcggcgcggggacctgcccgtgtggctggcccacaaggtggcgagcgagggcatcaagtacaccgaccggaagtggtgcttcgacggggagcgcaacaaccagatcctcgaggagaacatggacgtcgagatctggacgaaggagggcgagcggaagaagctgcgcccgcgctggctggacgcccggacctactccgaccccctcgccctgaaggagttcaaggacttcgccgccggccgcaagagcatcgcgctggacctcgtgaccgagatcgggcgggtgccctcccacctggcctaccgcacccggaacgccctggacaacctcgtcatgctgcacacgagcgagcacggcgggcgcgcctaccggcacgccgtggaggagctgccggagaccatggagaccctcctgctgctcggcctgatgatcctgctcaccgggggcgcgatgctgttcctgatcagcggcaaggggatcggcaagacgtccatcgggctcatctgcgtgatcgtcagctccggcatgctgtggatggccgacgtgcccctgcagtggatcgccagcgccatcatcctcgagttcttcatgatggtgctgctgatccccgagcccgagaagcagcgcaccccgcaggacaaccagctcgcctacgtcgtgatcgggatcctgaccctggcggccatcgtggccgccaacgagatgggcctcctggagaccacgaagcgggacctgggcatgtccaaggagcccggggtcgtgagccccacctcctacctcgacgtggacctgcaccccgccagcgcgtggaccctgtacgccgtcgccaccacggtgatcaccccgatgctccgccacaccatcgagaactccaccgccaacgtgagcctggcggccatcgccaaccaggccgtcgtgctgatgggcctcgacaaggggtggcccatctccaagatggacctgggcgtgcccctgctcgccctggggtgctacagccaggtcaaccccctgacgctcaccgcggccgtgctgctgctcgtgacccactacgccatcatcggcccgggcctgcaggccaaggccacccgggaggcgcagaagcgcacggccgccgggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcggaccagctgggccctgtgcgaggcgctgacgctcgccaccggccccatcaccaccctgtgggagggctccccggggaagttctggaacacgaccatcgccgtgagcatggccaacatcttccgcggctcctacctggcgggggccggcctcgccttcagcatcatgaagtccgtcgggaccggccggcgcggcaccgggagccagggcgagacgctgggggagaagtggaagaagaagctgaaccagctcagccggaaggagttcgacctgtacaagaagtccggcatcaccgaggtggaccgcaccgaggccaaggaggggctgaagcggggcgagaccacccaccacgccgtgagccgcggctccgcgaagctccagtggttcgtcgagcggaacatggtgatccccgaggggcgcgtgatcgacctgggctgcgggcgcggcgggtggagctactactgcgccggcctgaagaaggtcacggaggtgcggggctacaccaagggcgggcccgggcacgaggagcccgtgccgatgtccacctacggctggaacctcgtcaagctgatgagcgggaaggacgtgttctacctgccgcccgagaagtgcgacaccctgctctgcgacatcggcgagtccagcccctccccgacggtggaggagagccgcaccatccgggtcctgaagatggtggagccctggctgaagaacaaccagttctgcatcaaggtgctcaacccctacatgcccaccgtcatcgagcacctggagcgcctgcagcggaagtacggcgggatgctcgtgcgcaacccgctgtcccggaacagcacccacgagatgtactggatctccaacggcacggggaacatcgtgagctccgtcaacatggtgagccgcctgctcctgaaccggttcaccatgacccaccgccggcccaccatcgagaaggacgtcgacctgggcgccggcacgcgccacgtgaacgccgagcccgagaccccgaacatggacgtgatcggggagcggatcaagcgcatcaaggaggagcactccagcacctggcactacgacgacgagaacccctacaagacctgggcctaccacggctcctacgaggtcaaggcgacggggagcgccagctccatgatcaacggcgtggtgaagctcctgaccaagccctgggacgtcgtgcccatggtgacccagatggccatgaccgacacgaccccgttcgggcagcagcgggtcttcaaggagaaggtggacacccgcacgccccggcccatgcccggcacgcgcaaggtgatggagatcaccgccgagtggctgtggcggaccctcggccgcaacaagaagccgcgcctgtgcacccgggaggagttcacgaagaaggtccgcaccaacgccgcgatgggggccgtgttcaccgaggagaaccagtgggacagcgcccgggccgcggtggaggacgaggagttctggaagctggtcgaccgcgagcggaagctccacaagctgggcaagtgcgggtcctgcgtgtacaacatgatgggcaagcgcgagaagaagctgggggagttcggcaaggccaagggcagccgggccatctggtacatgtggctcggggcccgctacctggagttcgaggccctgggcttcctcaacgaggaccactggttctcccgggagaacagctactccggggtggagggcgaggggctgcacaagctgggctacatcctccgcgacatcagcaagatccccggcggggcgatgtacgccgacgacaccgccggctgggacacgcggatcaccgaggacgacctgcacaacgaggagaagatcacccagcagatggaccccgagcaccgccagctggccaacgccatcttcaagctcacctaccagaacaaggtcgtgaaggtgcagcggcccacgccgaaggggaccgtcatggacatcatctcccgcaaggaccagcggggcagcggccaggtggggacctacggcctgaacaccttcaccaacatggaggcgcagctggtgcgccagatggagggggagggcgtcctctccaaggccgacctggagaacccccacctcctcgagaagaagatcacgcagtggctggagaccaagggggtggagcggctgaagcgcatggccatcagcggcgacgactgcgtggtcaagcccatcgacgaccggttcgccaacgccctcctggcgctgaacgacatgggcaaggtgcgcaaggacatcccccagtggcagccgtccaaggggtggcacgactggcagcaggtccccttctgcagccaccacttccacgagctcatcatgaaggacggccggaagctggtcgtgccctgccgcccccaggacgagctgatcgggcgcgcccggatctcccagggcgccgggtggagcctcaaggagaccgcctgcctgggcaaggcctacgcgcagatgtggtccctgatgtacttccaccgccgggacctccgcctggccagcaacgccatctgctccgccgtgccggtccactggatccccaccagccggacgacctggagcatccacgcgcaccaccagtggatgaccaccgaggacatgctgacggtgtggaaccgcgtgtggatcgaggacaacccctggatggaggacaagacccccgtcaccacctgggaggacgtgccgtacctcggcaagcgggaggaccagtggtgcgggtccctgatcggcctgacgagccgcgccacctgggcccagaacatcctcaccgccatccagcaggtccggtccctgatcggggacgaggagttcctggactacatgcccagcatgaagcgcttccggaaggaggaggagtccgagggcgccatctggtga

SEQ ID NO: 10313 - RNA, 9873 nt, synthetic construct
  misc_feature 1..9873: note = derived and/or modified CDS sequence (opt1) from DENV-3__FJ562099__SS-prME
  source 1..9873: mol_type = other RNA
accagcctgtgcctcatgatgatgctgcccgccaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgggacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtactcctggaagacctgggggaaggcgaagatcgtgacggccgagacccagaacagctccttcatcatcgacggccccaacacccccgagtgccccagcgcctcccgggcctggaacgtgtgggaggtcgaggactacgggttcggcgtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacaccctctggtccaacggcgtgctggagagcgacatgatcatccccaagtccctggcggggcccatcagccagcacaaccaccggccgggctaccacacgcagaccgccgggccctggcacctcggcaagctggagctggacttcaactactgcgagggcaccaccgtcgtgatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcaccttcgtcctcctgctgtccggccagatcacgtggcgcgacatggcgcacaccctcatcatgatcggcagcaacgcctccgaccggatggggatgggcgtgacctacctggccctgatcgccaccttcaagatccagcccttcctcgccctggggttcttcctgcgcaagctcacgagccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggccgcgatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcacggggacctccgccgacctgaccgtcgagaaggccgccgacgtgacctgggaggaggaggccgagcagacgggcgtgagccacaacctcatgatcaccgtcgacgacgacgggaccatgcgcatcaaggacgacgagaccgagaacatcctgaccgtgctgctcaagacggcgctgctgatcgtgtccggcgtcttcccctacagcatccccgccaccctcctggtgtggcacacctggcagaagcagacccagcggtccggcgtgctgtgggacgtccccagcccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggcctccgtgaagaaggacctcatcagctacggcgggggctggcggctgtccgcgcagtggcagaagggggaggaggtccaggtgatcgccgtggagcccggcaagaacccgaagaacttccagaccatgcccggcatcttccagaccaccacgggggagatcggcgccatcgccctggacttcaagcccgggaccagcggcagcccgatcatcaaccgcgagggcaaggtcgtggggctgtacggcaacggggtggtcaccaagaacggcgggtacgtgtccggcatcgcgcagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcccccacgcgggtcgtggcggccgagatggaggaggccctgaaggggctgcccatccgctaccagaccaccgccaccaagtccgagcacacgggccgggagatcgtggacctcatgtgccacgccaccttcaccatgcgcctgctgagcccggtccgggtgcccaactacaacctcatcatcatggacgaggcgcacttcaccgaccccgcctccatcgccgcccgcgggtacatcagcacgcgggtgggcatgggcgaggccgcggccatcttcatgaccgccacgccgcccgggaccgccgaggcgttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgaagctcaacgactgggacttcgtggtgaccaccgacatcagcgagatgggcgccaacttcaaggcggaccgggtcatcgacccccgccggtgcctgaagcccgtgatcctgaccgacggccccgagcgcgtgatcctcgccgggccgatgcccgtcacggccgcctccgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgccgcgatcgacggcgagtaccgcctgaagggcgagtcccggaagaccttcgtcgagctcatgcgccgcggggacctgcccgtgtggctggcccacaaggtggccagcgagggcatcaagtacacggaccgcaagtggtgcttcgacggggagcggaacaaccagatcctcgaggagaacatggacgtcgagatctggaccaaggagggcgagcgcaagaagctgcggccgcgctggctggacgcccgcacctactccgaccccctcgcgctgaaggagttcaaggacttcgccgccggccgcaagagcatcgccctggacctcgtgaccgagatcgggcgcgtgccctcccacctggcctaccggacgcgcaacgcgctggacaacctcgtcatgctgcacaccagcgagcacggcgggcgggcctaccgccacgccgtggaggagctgccggagaccatggagaccctcctgctgctcggcctgatgatcctgctcaccggcggggccatgctgttcctgatcagcgggaaggggatcggcaagacctccatcgggctcatctgcgtgatcgtcagctccggcatgctgtggatggccgacgtgcccctgcagtggatcgcgagcgccatcgtgctcgagttcttcatgatggtcctgctgatccccgagcccgagaagcagcggaccccgcaggacaaccagctcgcctacgtggtgatcgggatcctgaccctggccgccatcgtcgcggccaacgagatgggcctcctggagacgaccaagcgcgacctgggcatgtccaaggagcccggggtggtgagccccacctcctacctcgacgtcgacctgcaccccgccagcgcctggaccctgtacgccgtggcgacgaccgtgatcaccccgatgctccggcacaccatcgagaactccacggccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacccactacgcgatcatcggcccgggcctgcaggccaaggccacgcgcgaggcccagaagcggaccgccgcggggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcgcacgagctgggccctgtgcgaggccctgaccctcgccaccggccccatcaccacgctgtgggagggctccccggggaagttctggaacaccaccatcgcggtcagcatggccaacatcttccggggctcctacctggccggggccggcctcgcgttcagcatcatgaagtccgtggggaccggccgccggggcacggggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagaccacgcaccacgccgtcagccggggctccgccaagctccagtggttcgtggagcgcaacatggtgatccccgaggggcgggtcatcgacctgggctgcgggcgcggcgggtggagctactactgcgccggcctgaagaaggtgaccgaggtgcgcggctacaccaagggcggccccgggcacgaggagcccgtcccgatgtccacctacggctggaacatcgtgaagctcatgagcgggaaggacgtgttctacctgccgcccgagaagtgcgacacgctgctgtgcgacatcggcgagtccagcccctccccgaccgtcgaggagagccggaccatccgcgtgctcaagatggtggagccctggctgaagaacaaccagttctgcatcaaggtcctgaacccctacatgcccaccgtgatcgagcacctcgagcggctgcagcgcaagtacggcgggatgctggtgcggaacccgctctcccgcaacagcacgcacgagatgtactggatctccaacggcaccgggaacatcgtcagctccgtgaacatggtcagccggctgctgctcaaccgcttcaccatgacccaccggcgccccacgatcgagaaggacgtggacctgggcgcgggcacccggcacgtgaacgccgagcccgagaccccgaacatggacgtcatcggggagcgcatcaagcggatcaaggaggagcactccagcacctggcactacgacgacgagaacccctacaagacgtgggcctaccacggctcctacgaggtgaaggccaccgggagcgccagctccatgatcaacggcgtggtcaagctgctcaccaagccctgggacgtggtgcccatggtcacccagatggcgatgacggacaccaccccgttcgggcagcagcgcgtgttcaaggagaaggtggacacccggacgccccgccccatgcccggcacccggaaggtcatggagatcaccgccgagtggctgtggcgcaccctgggccggaacaagaagccgcgcctctgcacgcgcgaggagttcaccaagaaggtgcggaccaacgccgccatgggggccgtgttcaccgaggagaaccagtgggacagcgcgcgcgccgccgtcgaggacgaggagttctggaagctggtggaccgggagcgcgagctgcacaagctcggcaagtgcgggtcctgcgtgtacaacatgatgggcaagcgggagaagaagctgggggagttcggcaaggccaagggcagccgcgcgatctggtacatgtggctgggggcccggtacctcgagttcgaggccctgggcttcctgaacgaggaccactggttctcccgcgagaacagctactccggggtcgagggcgaggggctccacaagctgggctacatcctgcgggacatcagcaagatccccggcggggccatgtacgccgacgacacggcgggctgggacacccgcatcaccgaggacgacctccacaacgaggagaagatcacccagcagatggaccccgagcaccggcagctggccaacgccatcttcaagctgacgtaccagaacaaggtggtgaaggtccagcgccccaccccgaaggggaccgtgatggacatcatctcccggaaggaccagcgcggcagcggccaggtggggacctacggcctcaacaccttcacgaacatggaggcccagctggtccggcagatggagggggagggcgtgctgtccaaggccgacctcgagaacccccacctcctggagaagaagatcacccagtggctcgagaccaagggggtggagcgcctgaagcggatggcgatcagcggcgacgactgcgtcgtgaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtggtgccctgccggccccaggacgagctgatcgggcgcgcccgcatctcccagggcgcggggtggagcctgaaggagaccgcctgcctcggcaaggcctacgcccagatgtggtccctgatgtacttccaccggcgcgacctgcggctcgccagcaacgcgatctgctccgccgtcccggtgcactggatccccacgagccgcaccacctggagcatccacgcccaccaccagtggatgaccacggaggacatgctgaccgtgtggaaccgggtctggatcgaggacaacccctggatggaggacaagacccccgtgaccacgtgggaggacgtgccgtacctgggcaagcgcgaggaccagtggtgcgggtccctcatcggcctgaccagccgggccacctgggcgcagaacatcctgaccgccatccagcaggtccgctccctcatcggggacgaggagttcctggactacatgcccagcatgaagcggttccgcaaggaggaggagtccgagggcgccatctggtga

SEQ ID NO: 10314 - RNA, 9873 nt, synthetic construct
  misc_feature 1..9873: note = derived and/or modified CDS sequence (opt1) from DENV-3__KF955457__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgcgagcgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggccaccgtggagatcacgccccaggccagcaccgtcgaggcggtgctgcccgagtacggcaccctcgggctggagtgctccccgcgcaccggcctggacttcaacgagatgatcctcctgaccatgaagaacaaggcctggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcgggtcccaggagggcgcgatgcacaccgccctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtgtccgagacccagcacgggacgatcctgatcaaggtcgagtacaagggcgaggacgcgccgtgcaagatccccttcagcaccgaggacgggcagggcaaggcccacaacggccgcctgatcaccgccaaccccgtggtgaccaagaaggaggagcccgtcaacatcgaggccgagccgcccttcggggagagcaacatcgtgatcggcatcggggacaaggcgctcaagatcaactggtacaagaagggctccagcatcgggaagatgttcgaggccacggcccggggcgcccgccggatggccatcctgggcgacaccgcgtgggacttcgggtccgtgggcggggtcctgaacagcctcggcaagatggtgcaccagatcttcgggtccgcctacaccgccctgttcagcggcgtgtcctggatcatgaagatcggcatcggggtcctgctcacctggatcggcctgaacagcaagaacacgtccatgagcttctcctgcatcgtgatcgggatcatcaccctgtacctcggcgccgtggtccaggccgacatggggtgcgcgatcaactggaagggcaaggagctgaagtgcggcagcgggatcttcgtgaccaacgaggtgcacacctggacggagcagtacaagttccaggccgactcccccaagcgcctggccaccgccatcgccggcgcgtgggagaacggggtctgcggcatccgcagcaccacccggatggagaacctcctgtggaagcagatcgccaacgagctgaactacatcctctgggagaacaacatcaagctgacggtggtggtcggggacatcatcggcgtgctggagcagggcaagcgcaccctcacgccccagccgatggagctgaagtactcctggaagacctgggggaaggccaagatcgtgacggccgagacccagaacttcagcttcatcatcgacggccccaacacccccgagtgcccctccgcgagccgggcctggaacgtctgggaggtggaggactacgggttcggcgtgttcaccacgaacatctggctgaagctccgcgaggtctacacccagtcctgcgaccaccggctgatgagcgccgccatcaaggacgagcgcgccgtgcacgcggacatgggctactggatcgagagccagaagaacgggtcctggaagctggagaaggccagcttcatcgaggtgaagacctgcacctggccgaagtcccacaccctctggagcaacggcgtcctggagtccgacatgatcatccccaagagcctggccgggcccatctcccagcacaaccaccggccgggctaccacacgcagaccgccgggccctggcacctcggcaagctggagctggacttcaactactgcgagggcaccaccgtggtgatcacggaggactgcgggacccgcggccccagcctccggaccaccacggtctccgggaagctgatccacgagtggtgctgccgcagctgcaccctgcccccgctccggtacatgggcgaggacgggtgctggtacggcatggagatccgccccatcaacgagaaggaggagaacatggtgaagtccctggtgagcgccggctccgggaaggtcgacaacttcaccatgggcgtgctgtgcctcgcgatcctgttcgaggaggtgatgcgggggaagttcggcaagaagcacatgatcgccggggtcctgttcaccttcgtgctcctgctgagcggccagatcacgtggcgcgacatggcccacaccctcatcatgatcggctccaacgccagcgaccggatggggatgggcgtgacctacctggccctgatcgcgaccttcaagatccagcccttcctcgccctggggttcttcctgcgcaagctcacgtcccgggagaacctgctgctcggcgtcggcctggccatggccaccaccctgcagctccccgaggacatcgagcagatggcgaacgggatcgccctgggcctgatgaccctcaagctgatcacgcagttcgagacctaccagctgtggaccgccctcgtgagcctgacctgcagcaacacgatcttcaccctgaccgtggcctggcgcaccgccacgctcatcctggcgggggtctccctgctcccgctgtgccagagctccagcatgcggaagaccgactggctgcccatgaccgtggccgccatgggcgtgccgcccctgccgctgttcatcttctccctgaaggacacccccaagcgccgcagctggcccctcaacgagggggtgatggccgtgggcctggtctccatcctggccagctccctcctgcggaacgacgtgcccatggcgggcccgctggtggccgggggcctcctgatcgcctgctacgtcatcacggggaccagcgccgacctgaccgtggagaaggccgcggacgtgacctgggaggaggaggccgagcagacgggcgtctcccacaacctcatgatcaccgtggacgacgacgggaccatgcgcatcaaggacgacgagaccgagaacatcctgaccgtgctgctcaagacggccctgctgatcgtcagcggcatcttcccctactccatccccgccaccctcctggtgtggcacacctggcagaagcagacccagcggagcggcgtgctgtgggacgtcccctccccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgcggtgctgacgcacaacgggaagcgcctggagcccaactgggccagcgtgaagaaggacctcatctcctacggcgggggctggcggctgagcgcccagtggcagaagggggaggaggtccaggtgatcgccgtggagcccggcaagaacccgaagaacttccagaccatgcccggcatcttccagaccaccacgggggagatcggcgcgatcgccctggacttcaagcccgggacctccggcagcccgatcatcaaccgcgagggcaaggtcgtggggctgtacggcaacggggtggtcaccaagaacggcgggtacgtgagcggcatcgcccagaccaacgccgagcccgacggccccacgcccgagctcgaggaggagatgttcaagaagcggaacctgaccatcatggacctgcacccggggtccggcaagacccgcaagtacctccccgccatcgtgcgggaggcgatcaagcgccggctgcgcaccctgatcctcgcccccacgcgggtcgtggccgccgagatggaggaggccctgaaggggctgcccatccgctaccagaccaccgcgaccaagagcgagcacacgggccgggagatcgtggacctcatgtgccacgccaccttcaccatgcgcctgctgtccccggtccgggtgcccaactacaacctcatcatcatggacgaggcccacttcaccgaccccgccagcatcgccgcgcgcgggtacatctccacgcgggtgggcatgggcgaggccgccgccatcttcatgaccgcgacgccgcccgggaccgccgaggccttcccccagagcaacgcccccatccaggacgaggagcgcgacatccccgagcgctcctggaacagcggcaacgagtggatcacggacttcgtcgggaagaccgtgtggttcgtgccctccatcaaggccggcaacgacatcgcgaactgcctgcggaagaacgggaagaaggtcatccagctgagccgcaagaccttcgacaccgagtaccagaagacgcggctcaacgactgggacttcgtggtgaccaccgacatctccgagatgggcgccaacttcaaggccgaccgcgtcatcgacccccggcgctgcctgaagcccgtgatcctgaccgacggccccgagcgggtgatcctcgccgggccgatgcccgtcacggccgcgagcgccgcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgcgctgttcgagcccgagcgcgagaagtccgccgccatcgacggcgagtaccggctgaagggcgagagccgcaagaccttcgtggagctcatgcggcgcggggacctgcccgtctggctggcccacaaggtggcgtccgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcccggacctacagcgaccccctcgccctgaaggagttcaaggacttcgccgccggccgcaagtccatcgcgctggacctcgtgaccgagatcgggcgggtgcccagccacctggcctaccgcacgcggaacgccctggacaacctcgtcatgctgcacacctccgagcacggcgggcgcgcctaccggcacgccgtggaggagctgccggagaccatggagaccctcctgctgctcggcctgatgatcctgctcaccggcggggcgatgctgttcctgatcagcgggaaggggatcggcaagaccagcatcgggctcatctgcgtgatcgtctccagcggcatgctgtggatggccgacgtgcccctgcagtggatcgcctccgccatcgtgctcgagttcttcatgatggtcctgctgatccccgagcccgagaagcagcgcaccccgcaggacaaccagctcgcctacgtggtgatcgggatcctgaccctggcggccatcgtcgccgccaacgagatgggcctcctggagacgaccaagcgggacctgggcatgagcaaggagcccggggtggtgtcccccaccagctacctcgacgtcgacctgcaccccgcctccgcgtggaccctgtacgccgtggccacgaccgtgatcaccccgatgctccgccacaccatcgagaacagcacggccaacgtctccctggcggccatcgccaaccaggccgtggtgctgatgggcctcgacaaggggtggcccatcagcaagatggacctgggcgtccccctgctcgccctggggtgctactcccaggtgaaccccctgaccctcaccgcggccgtgctgctgctcgtcacccactacgccatcatcggcccgggcctgcaggccaaggccacgcgggaggcgcagaagcgcaccgccgccgggatcatgaagaaccccaccgtggacggcatcatgaccatcgacctggaccccgtgatctacgacagcaagttcgagaagcagctcgggcaggtcatgctgctggtgctctgcgccgtgcagctgctgctcatgcggacgtcctgggccctgtgcgaggcgctgaccctcgccaccggccccatcaccacgctgtgggagggcagcccggggaagttctggaacaccaccatcgccgtctccatggccaacatcttccgcggcagctacctggcgggggccggcctcgccttctccatcatgaagtccgtggggaccggccggcgcggcacggggtcccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtctcccgcggcagcgcgaagctccagtggttcgtggaccggaacatggtgatccccgaggggcgcgtcatcgacctgggctgcgggcgcggcgggtggtcctactactgcgccggcctgaagaaggtgaccgaggtgcggggctacaccaagggcggccccgggcacgaggagcccgtcccgatgagcacctacggctggaacctcgtgaagctgatgtccgggaaggacgtgttctacctgccgcccgagaagtgcgacacgctgctctgcgacatcggcgagagctcccccagcccgaccgtcgaggagtcccgcaccatccgggtgctgaagatggtggagccctggctgaagaacaaccagttctgcatcaaggtcctcaacccctacatgcccaccgtgatcgagcacctggagcgcctgcagcggaagtacggcgggatgctcgtgcgcaacccgctgagccggaactccacgcacgagatgtactggatcagcaacggcaccgggaacatcgtctccagcgtgaacatggtgtcccgcctgctcctgaaccggttcaccatgacccaccgccggcccacgatcgagaaggacgtcgacctgggcgccggcacccgccacgtgaacgccgagcccgagaccccgaacatggacgtcatcggggagcggatcaagcgcatcaaggaggagcacagctccacctggcactacgacgacgagaacccctacaagacgtgggcctaccacggcagctacgaggtgaaggcgaccgggtccgccagcagcatgatcaacggcgtggtcaagctcctgaccaagccctgggacgtggtgcccatggtcacccagatggccatgacggacaccaccccgttcgggcagcagcgggtgttcaaggagaaggtggacacccgcacgccccggcccatgcccggcacccgcaaggtcatggagatcaccgccgagtggctgtggcggaccctcggccgcaacaagaagccgcgcctgtgcacgcgggaggagttcaccaagaaggtgcgcaccaacgccgcgatgggggccgtgttcaccgaggagaaccagtgggactccgcccgggccgcggtcgaggacgaggagttctggaagctggtggaccgcgagcgggagctccacaagctgggcaagtgcgggagctgcgtgtacaacatgatgggcaagcgcgagaagaagctgggggagttcggcaaggccaagggctcccgggccatctggtacatgtggctcggggcccgctacctggagttcgaggccctgggcttcctcaacgaggaccactggttcagccgggagaactcctacagcggggtcgagggcgaggggctgcacaagctgggctacatcctccgcgacatctccaagatccccggcggggcgatgtacgccgacgacacggccggctgggacacccggatcaccgaggacgacctgcacaacgaggagaagatcacccagcagatggaccccgagcaccgccagctggccaacgccatcttcaagctcacgtaccagaacaaggtggtgaaggtccagcggcccaccccgaaggggaccgtgatggacatcatcagccgcaaggaccagcggggctccggccaggtggggacctacggcctgaacaccttcacgaacatggaggcgcagctggtccgccagatggagggggagggcgtgctcagcaaggccgacctggagaacccccacctcctcgagaagaagatcacccagtggctggagaccaagggggtggagcggctgaagcgcatggccatctccggcgacgactgcgtcgtgaagcccatcgacgaccggttcgccaacgccctcctggcgctgaacgacatgggcaaggtgcgcaaggacatcccccagtggcagccgagcaaggggtggcacgactggcagcaggtccccttctgctcccaccacttccacgagctcatcatgaaggacggccggaagctggtggtgccctgccgcccccaggacgagctgatcgggcgcgcccggatcagccagggcgccgggtggtccctcaaggagaccgcctgcctgggcaaggcctacgcgcagatgtggagcctgatgtacttccaccgccgggacctccgcctggcctccaacgccatctgcagcgccgtcccggtgcactggatccccacgtcccggaccacctggagcatccacgcgcaccaccagtggatgaccacggaggacatgctgaccgtgtggaaccgcgtctggatcgaggacaacccctggatggaggacaagacccccgtgaccacgtgggaggacgtgccgtacctcggcaagcgggaggaccagtggtgcgggagcctgatcggcctgacctcccgcgccacctgggcccagaacatcctcaccgccatccagcaggtccggagcctgatcggggacgaggagttcctggactacatgccctccatgaagcgcttccggaaggaggaggagagcgagggcgccatctggtga

SEQ ID NO: 10315 - RNA, 9873 nt, synthetic construct
  misc_feature 1..9873: note = derived and/or modified CDS sequence (opt1) from DENV-3__FJ562100__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccatcctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtgtccgagacccagcacgggacgatcctgatcaaggtcgagtacaagggcgaggacgccccgtgcaagatccccttcagcaccgaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacctggatcggcctgaacagcaagaacacgtccatgagcttctcctgcatcgtgatcgggatcatcaccctgtacctcggcgccgtggtccaggccgacatggggtgcgccatcaactggaagggcaaggagctgaagtgcggcagcgggatcttcgtgaccaacgaggtgcacacctggacggagcagtacaagttccaggcggactcccccaagcgcctggccaccgccatcgccggcgcctgggagaacggggtctgcggcatccgcagcaccacccggatggagaacctcctgtggaagcagatcgcgaacgagctgaactacatcctctgggagaacaacatcaagctgacggtggtggtcggggacatcatcggcgtgctggagcagggcaagcgcaccctcacgccccagccgatggagctgaagtactcctggaagacctgggggaaggccaagatcgtgacggccgagacccagaacagctccttcatcatcgacggccccaacacccccgagtgccccagcgcctcccgggcgtggaacgtctgggaggtggaggactacgggttcggcgtgttcaccacgaacatctggctgaagctccgcgaggtctacacccagagctgcgaccaccggctgatgagcgccgccatcaaggacgagcgcgccgtgcacgccgacatgggctactggatcgagtcccagaagaacgggagctggaagctggagaaggcgtccttcatcgaggtgaagacctgcacctggcccaagagccacaccctctggtccaacggcgtcctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtgatcacggagaactgcgggacccgcggcccctccctccggaccaccacggtcagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcctgttcaccttcgtgctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtcggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgccgctcctggcccctcaacgagggggtgatggccgtgggcctggtcagcatcctggcctccagcctcctgcggaacgacgtgcccatggccggcccgctggtggccggcgggctcctgatcgcctgctacgtcatcacggggacctccgccgacctgaccgtggagaaggccgccgacgtgacctgggaggaggaggcggagcagacgggggtcagccacaacctcatgatcaccgtggacgacgacgggaccatgcgcatcaaggacgacgagaccgagaacatcctgaccgtgctgctcaagacggccctgctgatcgtctccggcatcttcccctacagcatccccgccaccctcctggtgtggcacacctggcagaagcagacccagcggtccggcgtgctgtgggacgtccccagcccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggcgtccgtgaagaaggacctcatcagctacggcgggggctggcggctgtccgcccagtggcagaagggggaggaggtccaggtgatcgccgtggagcccggcaagaacccgaagaacttccagaccatgcccggcatcttccagaccaccacgggggagatcggcgccatcgcgctggacttcaagcccgggaccagcggcagcccgatcatcaaccgcgagggcaaggtcgtggggctgtacggcaacggggtggtcaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcgcccacgcgggtcgtggccgccgagatggaggaggccctgaaggggctgcccatccgctaccagaccaccgccaccaagtccgagcacacgggccgggagatcgtggacctcatgtgccacgcgaccttcaccatgcgcctgctgagcccggtccgggtgcccaactacaacctcatcatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgcgaacttcaaggccgaccgcgtcatcgacccccggcgctgcctgaagcccgtgatcctgaccgacggccccgagcgggtgatcctcgccgggccgatgcccgtcacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtggagctcatgcggcgcggggacctgcccgtctggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgtaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacctccatcgggctcatctgcgtgaccgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgacgctggccgcgatcgtcgccgccaacgagatgggcctcctggagaccaccaagcgggacctgggcatgtccaaggagcccggggtggtgagccccacctcctacctcgacgtcgacctgcaccccgccagcgcctggacgctgtacgcggtggccaccaccgtgatcaccccgatgctccgccacacgatcgagaactccaccgccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacgcactacgccatcatcggcccgggcctgcaggccaaggccacccgggaggcccagaagcgcaccgcggccgggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgcgaccggccccatcacgaccctgtgggagggctccccggggaagttctggaacaccaccatcgccgtcagcatggccaacatcttccgcggctcctacctggccggggcgggcctcgccttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacgtacggctggaacctcgtgaagctgatgagcgggaaggacgtgttctacctgccgcccgagaagtgcgacaccctgctctgcgacatcggcgagtccagcccctccccgaccgtcgaggagagccgcaccatccgggtgctgaagatggtggagccctggctgaagaacaaccagttctgcatcaaggtcctcaacccctacatgcccacggtgatcgagcacctggagcgcctgcagcggaagtacggcgggatgctcgtgcgcaacccgctgtcccggaacagcacccacgagatgtactggatctccaacggcaccgggaacatcgtcagctccgtgaacatggtgagccgcctgctcctgaaccggttcaccatgacgcaccgccggcccaccatcgagaaggacgtcgacctgggcgccggcacccgccacgtgaacgccgagcccgagaccccgaacatggacgtcatcggggagcggatcaagcgcatcaaggaggagcactccagcacgtggcactacgacgacgagaacccctacaagacctgggcctaccacggctcctacgaggtgaaggccaccgggagcgcgagctccatgatcaacggcgtggtcaagctcctgaccaagccctgggacgtggtgcccatggtcacgcagatggccatgaccgacaccaccccgttcgggcagcagcgggtgttcaaggagaaggtggacacgcgcacgccccggcccatgcccggcacccgcaaggtcatggagatcaccgccgagtggctgtggcggacgctcggccgcaacaagaagccgcgcctgtgcacccgggaggagttcaccaagaaggtgcgcaccaacgccgccatgggggcggtgttcacggaggagaaccagtgggacagcgcccgggccgccgtcgaggacgaggagttctggaagctggtggaccgcgagcgggagctccacaagctgggcaagtgcgggtcctgcgtgtacaacatgatgggcaagcgcgagaagaagctgggggagttcggcaaggcgaagggcagccgggccatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggccatgtacgcggacgacaccgccggctgggacacccggatcaccgaggacgacctgcacaacgaggagaagatcacgcagcagatggaccccgagcaccgccagctggccaacgccatcttcaagctcacctaccagaacaaggtggtgaaggtccagcggcccaccccgaaggggaccgtgatggacatcatctcccgcaaggaccagcggggcagcggccaggtggggacctacggcctgaacacgttcaccaacatggaggcccagctggtccgccagatggagggggagggcgtgctctccaaggcggacctggagaacccccacctcctcgagaagaagatcacccagtggctggagaccaagggggtggagcggctgaagcgcatggccatcagcggcgacgactgcgtcgtgaagcccatcgacgaccggttcgccaacgccctcctggccctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcgcggatctcccagggcgccgggtggagcctcaaggagacggcctgcctgggcaaggcctacgcccagatgtggtccctgatgtacttccaccgccgggacctccgcctggcgagcaacgccatctgctccgccgtcccggtgcactggatccccaccagccggaccacctggagcatccacgcccaccaccagtggatgacgaccgaggacatgctgaccgtgtggaaccgcgtctggatcgaggacaacccctggatggaggacaagacccccgtgacgacctgggaggacgtgccgtacctcggcaagcgggaggaccagtggtgcgggtccctgatcggcctgaccagccgcgcgacctgggcccagaacatcctcacggccatccagcaggtccggtccctgatcggggacgaggagttcctggactacatgcccagcatgaagcgcttccggaaggaggaggagtccgagggcgccatctggtga

SEQ ID NO: 10316 - RNA, 9873 nt, synthetic construct
  misc_feature 1..9873: note = derived and/or modified CDS sequence (opt1) from DENV-3__FJ547062__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatctccaccagcctgacccagaaggtggtgatcttcatcctgctcatgctggtcacgccctccatgaccatgcggtgcgtgggcgtggggaaccgcgacttcgtcgagggcctgagcggcgccacctgggtggacgtggtcctcgagcacgggggctgcgtgaccacgatggccaagaacaagcccaccctggacatcgagctgcagaagaccgaggccacccagctcgcgacgctgcggaagctgtgcatcgaggggaagatcaccaacatcaccaccgactcccgctgccccacgcagggcgaggccatcctcccggaggagcaggaccagaactacgtgtgcaagcacacctacgtcgaccggggctgggggaacggctgcgggctgttcggcaaggggagcctggtgacctgcgccaagttccagtgcctcgagcccatcgagggcaaggtggtccagtacgagaacctgaagtacaccgtgatcatcacggtgcacaccggcgaccagcaccaggtcgggaacgacacccagggcgtgaccgtcgagatcacgccccaggcctccaccgtggaggccatcctgcccgagtacgggaccctcggcctggagtgcagcccgcgcaccgggctggacttcaacgagatgatcctcctgaccatgaagaacaaggcgtggatggtgcaccggcagtggttcttcgacctgcccctcccctggacgtccggcgccaccaccgagacccccacgtggaaccgcaaggagctgctggtcaccttcaagaacgcccacgccaagaagcaggaggtggtggtcctcggcagccaggagggggccatgcacaccgcgctgaccggcgccacggagatccagaactccgggggcaccagcatcttcgccgggcacctgaagtgccggctcaagatggacaagctggagctgaagggcatgtcctacgccatgtgcctcaacaccttcgtgctgaagaaggaggtgagcgagacccagcacggcacgatcctgatcaaggtcgagtacaagggggaggacgccccgtgcaagatccccttcagcaccgaggacggccaggggaaggcgcacaacggccgcctgatcaccgccaaccccgtggtgaccaagaaggaggagcccgtcaacatcgaggccgagccgcccttcggcgagtccaacatcgtgatcgggatcggcgacaaggccctcaagatcaactggtacaagaaggggagctccatcggcaagatgttcgaggcgacggcccgcggggcccgccggatggccatcctgggcgacaccgcctgggacttcggcagcgtcgggggcgtcctgaactccctcgggaagatggtgcaccagatcttcggcagcgcgtacaccgccctgttctccggggtgagctggatcatgaagatcggcatcggcgtcctgctcacctggatcgggctgaactccaagaacacgagcatgtccttcagctgcatcgtgatcggcatcatcaccctgtacctcggggccgtggtccaggccgacatgggctgcgccatcaactggaaggggaaggagctgaagtgcggctccggcatcttcgtgaccaacgaggtgcacacctggacggagcagtacaagttccaggcggacagccccaagcgcctggccaccgccatcgccggggcctgggagaacggcgtctgcgggatccgctccaccacccggatggagaacctcctgtggaagcagatcgcgaacgagctgaactacatcctctgggagaacaacatcaagctgacggtggtggtcggcgacatcatcggggtgctggagcagggcaagcgcaccctcacgccccagccgatggagctgaagtacagctggaagacctggggcaaggccaagatcgtgacggccgagacccagaactccagcttcatcatcgacgggcccaacacccccgagtgcccctccgccagccgggcgtggaacgtctgggaggtggaggactacggcttcggggtgttcaccacgaacatctggctgaagctccgcgaggtctacacccagagctgcgaccaccggctgatgtccgccgccatcaaggacgagcgcgccgtgcacgccgacatgggctactggatcgagagccagaagaacggctcctggaagctggagaaggcgagcttcatcgaggtgaagacctgcacctggccgaagtcccacaccctctggagcaacggggtcctggagtccgacatgatcatccccaagagcctggccggccccatctcccagcacaaccaccggccggggtaccacacgcagaccgccggcccctggcacctcgggaagctggagctggacttcaactactgcgagggcaccaccgtggtgatcacggagaactgcggcacccgcgggcccagcctccggaccaccacggtctccggcaagctgatccacgagtggtgctgccgcagctgcaccctgcccccgctccggtacatgggggaggacggctgctggtacgggatggagatccgccccatcaacgagaaggaggagaacatggtgaagtccctggtgagcgccggctccggcaaggtcgacaacttcaccatgggggtgctgtgcctcgccatcctgttcgaggaggtgatgcggggcaagttcgggaagaagcacatgatcgcgggcgtcctgttcaccttcgtgctcctgctgagcgggcagatcacgtggcgcgacatggcccacaccctcatcatgatcggctccaacgccagcgaccggatgggcatgggggtgacctacctggccctgatcgccaccttcaagatccagcccttcctcgcgctgggcttcttcctgcgcaagctcacgagccgggagaacctgctgctcggggtcggcctggccatggccaccaccctgcagctccccgaggacatcgagcagatggccaacggcatcgcgctggggctgatgaccctcaagctgatcacgcagttcgagacctaccagctgtggaccgccctcgtgtccctgacctgcagcaacacgatcttcaccctgaccgtggcctggcgcaccgccacgctcatcctggccggcgtctccctgctcccgctgtgccagagctccagcatgcggaagaccgactggctgcccatgaccgtggcggccatgggggtgccgcccctgccgctgttcatcttctccctgaaggacacccccaagcgccgcagctggcccctcaacgagggcgtgatggccgtggggctggtctccatcctggccagctccctcctgcggaacgacgtgcccatggccggcccgctggtggcgggcgggctcctgatcgcctgctacgtcatcacgggcaccagcgccgacctgaccgtggagaaggccgccgacgtgacctgggaggaggaggcggagcagacgggggtctcccacaacctcatgatcaccgtggacgacgacggcaccatgcgcatcaaggacgacgagaccgagaacatcctgaccgtgctgctcaagacggccctgctgatcgtcagcgggatcttcccctactccatccccgccaccctcctggtgtggcacacctggcagaagcagacccagcggagcggcgtgctgtgggacgtcccctccccgcccgagacgcagaaggccgagctcgaggagggcgtgtaccgcatcaagcagcaggggatcttcggcaagacccaggtgggggtcggcgtgcagaaggagggggtgttccacaccatgtggcacgtcacccggggcgccgtgctgacgcacaacggcaagcgcctggagcccaactgggcgagcgtgaagaaggacctcatctcctacgggggcgggtggcggctgagcgcccagtggcagaagggcgaggaggtccaggtgatcgccgtggagcccgggaagaacccgaagaacttccagaccatgcccggcatcttccagaccaccacgggcgagatcggggccatcgcgctggacttcaagcccggcaccagcgggtccccgatcatcaaccgcgagggcaaggtcgtgggcctgtacgggaacggcgtggtcaccaagaacgggggctacgtgagcgggatcgcccagaccaacgccgagcccgacggccccacgcccgagctcgaggaggagatgttcaagaagcggaacctgaccatcatggacctgcacccgggctccgggaagacccgcaagtacctccccgccatcgtgcgggaggccatcaagcgccggctgcgcaccctgatcctcgcgcccacgcgggtcgtggccgccgagatggaggaggccctgaagggcctgcccatccgctaccagaccaccgccaccaagagcgagcacacggggcgggagatcgtggacctcatgtgccacgcgaccttcaccatgcgcctgctgtccccggtccgggtgcccaactacaacctcatcatcatggacgaggcccacttcaccgaccccgccagcatcgccgcccgcggctacatctccacgcgggtggggatgggcgaggcggccgccatcttcatgaccgccacgccgcccggcaccgcggaggccttcccccagagcaacgcccccatccaggacgaggagcgcgacatccccgagcgctcctggaacagcgggaacgagtggatcacggacttcgtcggcaagaccgtgtggttcgtgccctccatcaaggccgggaacgacatcgccaactgcctgcggaagaacggcaagaaggtcatccagctgagccgcaagaccttcgacaccgagtaccagaagacgcggctcaacgactgggacttcgtggtgaccaccgacatctccgagatgggggcgaacttcaaggccgaccgcgtcatcgacccccggcgctgcctgaagcccgtgatcctgaccgacggccccgagcgggtgatcctcgccggcccgatgcccgtcacggccgccagcgcggcccagcgccgggggcgcgtgggccggaacccccagaaggagaacgaccagtacatcttcaccgggcagcccctgaacaacgacgaggaccacgcccactggaccgaggccaagatgctgctcgacaacatcaacaccccggagggcatcatccccgccctgttcgagcccgagcgcgagaagtccgcggccatcgacggggagtaccggctgaagggcgagagccgcaagaccttcgtggagctcatgcggcgcggcgacctgcccgtctggctggcccacaaggtggcctccgaggggatcaagtacacggaccggaagtggtgcttcgacggcgagcgcaacaaccagatcctcgaggagaacatggacgtcgagatctggaccaaggagggggagcggaagaagctgcgcccgcgctggctggacgcgcggacctacagcgaccccctcgccctgaaggagttcaaggacttcgccgccggccgcaagtccatcgccctggacctcgtgaccgagatcggccgggtgcccagccacctggcgtaccgcacgcggaacgccctggacaacctcgtcatgctgcacaccagcgagcacgggggccgcgcctaccggcacgccgtggaggagctgccggagaccatggagaccctcctgctgctcgggctgatgatcctgctcacgggcggggccatgctgttcctgatctccggcaagggcatcgggaagaccagcatcggcctcatctgcgtgatcgtctccagcgggatgctgtggatggcggacgtgcccctgcagtggatcgcctccgccatcgtgctcgagttcttcatgatggtcctgctgatccccgagcccgagaagcagcgcaccccgcaggacaaccagctcgcctacgtggtgatcggcatcctgaccctggccgcgatcgtcgccgccaacgagatggggctcctggagacgaccaagcgggacctgggcatgagcaaggagcccggcgtggtgtcccccaccagctacctcgacgtcgacctgcaccccgcctccgcctggaccctgtacgcggtggccacgaccgtgatcaccccgatgctccgccacaccatcgagaacagcacggccaacgtctccctggccgcgatcgccaaccaggccgtggtgctgatggggctcgacaagggctggcccatcagcaagatggacctgggggtccccctgctcgccctgggctgctactcccaggtgaaccccctgaccctcaccgccgcggtgctgctgctcgtcacccactacgccatcatcgggccgggcctgcaggccaaggccacgcgggaggcccagaagcgcaccgcggccggcatcatgaagaaccccaccgtggacgggatcatgaccatcgacctggaccccgtgatctacgacagcaagttcgagaagcagctcggccaggtcatgctgctggtgctctgcgccgtgcagctgctgctcatgcggacgtcctgggccctgtgcgaggccctgaccctcgcgaccgggcccatcaccacgctgtgggagggcagcccgggcaagttctggaacaccaccatcgccgtctccatggccaacatcttccgcgggagctacctggccggcgcggggctcgccttctccatcatgaagtccgtgggcaccgggcggcgcggcacgggcagccagggggagaccctgggcgagaagtggaagaagaagctgaaccagctctcccggaaggagttcgacctgtacaagaagtccgggatcaccgaggtggaccgcaccgaggccaaggagggcctgaagcgcggggagaccacgcaccacgccgtctcccgcggcagcgccaagctccagtggttcgtggagcggaacatggtgatccccgagggccgcgtcatcgacctggggtgcggccgcgggggctggtcctactactgcgcggggctgaagaaggtgaccgaggtgcggggctacaccaagggcgggcccggccacgaggagcccgtcccgatgagcacctacgggtggaacctcgtgaagctgatgtccggcaaggacgtgttctacctgccgcccgagaagtgcgacacgctgctctgcgacatcggggagagctcccccagcccgaccgtcgaggagtcccgcaccatccgggtgctgaagatggtggagccctggctgaagaacaaccagttctgcatcaaggtcctcaacccctacatgcccaccgtgatcgagcacctggagcgcctgcagcggaagtacggcggcatgctcgtgcgcaacccgctgagccggaactccacgcacgagatgtactggatcagcaacgggaccggcaacatcgtctccagcgtgaacatggtgtcccgcctgctcctgaaccggttcaccatgacccaccgccggcccacgatcgagaaggacgtcgacctgggggccggcacccgccacgtgaacgccgagcccgagaccccgaacatggacgtcatcggcgagcggatcaagcgcatcaaggaggagcacagctccacctggcactacgacgacgagaacccctacaagacgtgggcctaccacgggagctacgaggtgaaggccaccggcagcgcgtccagcatgatcaacggggtggtcaagctcctgaccaagccctgggacgtggtgcccatggtcacccagatggccatgacggacaccaccccgttcggccagcagcgggtgttcaaggagaaggtggacacccgcacgccccggcccatgcccgggacccgcaaggtcatggagatcaccgccgagtggctgtggcggaccctcggccgcaacaagaagccgcgcctgtgcacgcgggaggagttcaccaagaaggtgcgcaccaacgccgccatgggcgcggtgttcaccgaggagaaccagtgggactccgcccgggccgccgtcgaggacgaggagttctggaagctggtggaccgcgagcgggagctccacaagctggggaagtgcggcagctgcgtgtacaacatgatggggaagcgcgagaagaagctgggcgagttcgggaaggcgaagggctcccgggccatctggtacatgtggctcggcgcccgctacctggagttcgaggccctggggttcctcaacgaggaccactggttcagccgggagaactcctacagcggcgtcgagggggagggcctgcacaagctggggtacatcctccgcgacatctccaagatccccggcggcgccatgtacgcggacgacacggccgggtgggacacccggatcaccgaggacgacctgcacaacgaggagaagatcacccagcagatggaccccgagcaccgccagctggccaacgccatcttcaagctcacgtaccagaacaaggtggtgaaggtccagcggcccaccccgaagggcaccgtgatggacatcatcagccgcaaggaccagcgggggtccggccaggtgggcacctacgggctgaacaccttcacgaacatggaggcccagctggtccgccagatggagggcgagggggtgctcagcaaggcggacctggagaacccccacctcctcgagaagaagatcacccagtggctggagaccaagggcgtggagcggctgaagcgcatggccatctccggggacgactgcgtcgtgaagcccatcgacgaccggttcgccaacgccctcctggccctgaacgacatgggcaaggtgcgcaaggacatcccccagtggcagccgagcaagggctggcacgactggcagcaggtccccttctgctcccaccacttccacgagctcatcatgaaggacgggcggaagctggtggtgccctgccgcccccaggacgagctgatcggccgcgcgcggatcagccagggggccggctggtccctcaaggagaccgcctgcctggggaaggcctacgcccagatgtggagcctgatgtacttccaccgccgggacctccgcctggcgtccaacgccatctgcagcgccgtcccggtgcactggatccccacgagccggaccacctggtccatccacgcccaccaccagtggatgaccacggaggacatgctgaccgtgtggaaccgcgtctggatcgaggacaacccctggatggaggacaagacccccgtgaccacgtgggaggacgtgccgtacctcggcaagcgggaggaccagtggtgcggcagcctgatcgggctgacctcccgcgcgacctgggcccagaacatcctcaccgccatccagcaggtccggagcctgatcggcgacgaggagttcctggactacatgccctccatgaagcgcttccggaaggaggaggagagcgagggggccatctggtga

SEQ ID NO: 10317 - RNA, 9873 nt, synthetic construct
  misc_feature 1..9873: note = derived and/or modified CDS sequence (opt1) from DENV-3__FJ461322__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccggtgcgggtgcccaactacaacctcatcatcatggacgaggcccacttcaccgaccccgcctccatcgccgcccgcgggtacatcagcacgcgggtcggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtggggaagaccgtgtggttcgtccccagcatcaaggccggcaacgacatcgccaactgcctgcggaagaacgggaagaaggtgatccagctgtcccgcaagaccttcgacaccgagtaccagaagacgcggctcaacgactgggacttcgtggtcaccaccgacatcagcgagatgggcgcgaacttcaaggccgaccgcgtgatcgacccccggcgctgcctgaagcccgtgatcctgaccgacggccccgagcgggtcatcctcgccgggccgatgcccgtgacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgtaccgcacgcggaacgccctggacaacctcgtgatgctgcacaccagcgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtcatcgtgagctccggcatgctgtggatggcggaggtgcccctgcagtggatcgccagcgccatcgtcctcgagttcttcatgatggtgctgctgatccccgagcccgagaagcagcgcaccccgcaggacaaccagctcgcctacgtggtcatcgggatcctgaccctggccgcgatcgtggccgccaacgagatgggcctcctggagacgaccaagcgggacctgggcatgtccaaggagcccggggtggtcagccccacctcctacctcgacgtggacctgcaccccgccagcgcctggaccctgtacgcggtggccacgaccgtcatcaccccgatgctccgccacaccatcgagaactccacggccaacgtgagcctggccgcgatcgccaaccaggccgtggtcctgatgggcctcgacaaggggtggcccatctccaagatggacctgggcgtgcccctgctcgccctggggtgctacagccaggtgaaccccctgaccctcaccgccgcggtcctgctgctcgtgacccactacgccatcatcggcccgggcctgcaggccaaggccacgcgggaggcccagaagcgcaccgcggccgggatcatgaagaaccccaccgtggacggcatcatgaccatcgacctggaccccgtcatctacgactccaagttcgagaagcagctcggccaggtgatgctgctggtgctctgcgccgtccagctgctgctcatgcggacgagctgggccctgtgcgaggccctgaccctcgcgaccggccccatcaccacgctgtgggagggctccccggggaagttctggaacaccaccatcgccgtgagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtcgaccgcaccgaggccaaggaggggctgaagcggggcgagaccacgcaccacgccgtgagccgcggctccgccaagctccagtggttcgtggagcggaacatggtcatccccgaggggcgcgtgatcgacctgggctgcgggcgcggcgggtggagctactactgcgcgggcctgaagaaggtgaccgaggtccggggctacaccaagggcggccccgggcacgaggagcccgtgccgatgtccacctacggctggaacatcgtgaagctcatgagcgggaaggacgtcttctacctgccgcccgagaagtgcgacacgctgctgtgcgacatcggcgagtccagcccctccccgaccgtggaggagagccgcaccatccgggtgctcaagatggtcgagccctggctgaagaacaaccagttctgcatcaaggtgctgaacccctacatgcccaccgtgatcgagcacctcgagcgcctgcagcggaagtacggcgggatgctggtccgcaacccgctctcccggaacagcacgcacgagatgtactggatctccaacggcaccgggaacatcgtgagctccgtgaacatggtcagccgcctgctgctcaaccggttcaccatgacccaccgccggcccacgatcgagaaggacgtggacctgggcgccggcacccgccacgtcaacgccgagcccgagaccccgaacatggacgtgatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtcgtgaagctgctcaccaagccctgggacgtggtccccatggtgacccagatggccatgacggacaccaccccgttcgggcagcagcgggtgttcaaggagaaggtcgacacccgcacgccccggcccatgcccggcacccgcaaggtgatggagatcaccgccgagtggctgtggcggaccctgggccgcaacaagaagccgcgcctctgcacgcgggaggagttcaccaagaaggtgcgcaccaacgccgccatgggggcggtcttcaccgaggagaaccagtgggacagcgcccgggccgccgtggaggacgaggagttctggaagctggtggaccgcgagcgggagctgcacaagctcggcaagtgcgggtcctgcgtctacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgcggacgacacggccggctgggacacccggatcaccgaggacgacctccacaacgaggagaagatcacccagcagatggaccccgagcaccgccagctggccaacgccatcttcaagctgacgtaccagaacaaggtggtcaaggtgcagcggcccaccccgaaggggaccgtgatggacatcatctcccgcaaggaccagcggggcagcggccaggtcgggacctacggcctcaacaccttcacgaacatggaggcccagctggtgcgccagatggagggggagggcgtgctgtccaaggcggacctcgagaacccccacctcctggagaagaagatcacccagtggctcgagaccaagggggtcgagcggctgaagcgcatggccatcagcggcgacgactgcgtggtgaagcccatcgacgaccggttcgccaacgccctgctcgccctgaacgacatgggcaaggtccgcaaggacatcccccagtggcagccgtccaaggggtggcacgactggcagcaggtccccttctgcagccaccacttccacgagctgatcatgaaggacggccggaagctcgtggtcccctgccgcccccaggacgagctgatcgggcgcgcgcggatctcccagggcgccgggtggagcctgaaggagaccgcctgcctcggcaaggcctacgcccagatgtggtccctgatgtacttccaccgccgggacctgcgcctcgcgagcaacgccatctgctccgccgtgccggtgcactggatccccacgagccggaccacctggagcatccacgcccaccaccagtggatgaccacggaggacatgctgaccgtctggaaccgcgtgtggatcgaggacaacccctggatggaggacaagacccccgtgaccacgtgggaggacatcccgtacctgggcaagcgggaggaccagtggtgcgggtccctcatcggcctgaccagccgcgcgacctgggcccagaacatcctgaccgccatccagcaggtccggtccctcatcggggacgaggagttcctggactacatgcccagcatgaagcgcttccggaaggaggaggagtccgagggcgccatctggtga

SEQ ID NO: 10318 - RNA, 9873 nt, synthetic construct
  misc_feature 1..9873: note = derived and/or modified CDS sequence (opt1) from DENV-3__KF955458__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgaacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccggtgcgggtgcccaactacaacctcatcatcatggacgaggcccacttcaccgaccccgcctccatcgccgcccgcgggtacatcagcacgcgggtcggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtggggaagaccgtgtggttcgtccccagcatcaaggccggcaacgacatcgccaactgcctgcggaagaacgggaagaaggtgatccagctgtcccgcaagaccttcgacaccgagtaccagaagacgcggctcaacgactgggacttcgtggtcaccaccgacatcagcgagatgggcgcgaacttcaaggccgaccgcgtgatcgacccccggcgctgcctgaagcccgtgatcctgaccgacggccccgagcgggtcatcctcgccgggccgatgcccgtgacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgtaccgcacgcggaacgccctggacaacctcatgatgctgcacaccagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacctacggctggaacctcgtgaagctgatgagcgggaaggacgtgttctacctgccgcccgagaagtgcgacacgctgctctgcgacatcggcgagtccagcccctccccgaccgtcgaggagagccgcaccatccgggtgctgaagatggtggagccctggctgaagaacaaccagttctgcatcaaggtcctcaacccctacatgcccaccgtgatcgagcacctggagcgcctgcagcggaagtacggcgggatgctcgtgcgcaacccgctgtcccggaacagcacgcacgagatgtactggatctccaacggcaccgggaacatcgtcagctccgtgaacatggtgagccgcctgctcctgaaccggttcaccatgacccaccgccggcccacgatcgagaaggacgtcgacctgggcgccggcacccgccacgtgaacgccgagcccgagaccccgaacatggacgtcatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtggtcaagctcctgaccaagccctgggacgtggtgcccatggtcacccagatggccatgacggacaccaccccgttcgggcagcagcgggtgttcaaggagaaggtggacacccgcacgccccggcccatgcccggcacccgcaaggtcatggagatcaccgccgagtggctgtggcggaccctcggccgcaacaagaagccgcgcctgtgcacgcgggaggagttcaccaagaaggtgcgcaccaacgccgccatgggggcggtgttcaccgaggagaaccagtgggacagcgcccgggccgccgtcgaggacgaggagttctggaagctggtggaccgcgagcgggagctccacaagctgggcaagtgcgggtcctgcgtgtacaacatgatgggcaagcgcgagaagaagctgggggagttcggcaaggcgaagggcagccgggccatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggccatgtacgcggacgacacggccggctgggacacccggatcaccgaggacgacctgcacaacgaggagaagatcacccagcagatggaccccgagcaccgccagctggccaacgccatcttcaagctcacgtaccagaacaaggtggtgaaggtccagcggcccaccccgaaggggaccgtgatggacatcatctcccgcaaggaccagcggggcagcggccaggtggggacctacggcctgaacaccttcacgaacatggaggcccagctggtccgccagatggagggggagggcgtgctctccaaggcggacctggagaacccccacctcctcgagaagaagatcacccagtggctggagaccaagggggtggagcggctgaagcgcatggccatcagcggcgacgactgcgtcgtgaagcccatcgacgaccggttcgccaacgccctcctggccctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcgcggatctcccagggcgccgggtggagcctcaaggagaccgcctgcctgggcaaggcctacgcccagatgtggtccctgatgtacttccaccgccgggacctccgcctggcgagcaacgccatctgctccgccgtcccggtgcactggatccccacgagccggaccacctggagcatccacgcccaccaccagtggatgaccacggaggacatgctgaccgtgtggaaccgcgtctggatcgaggacaacccctggatggaggacaagacccccgtgaccacgtgggaggacgtgccgtacctcggcaagcgggaggaccagtggtgcgggtccctgatcggcctgaccagccgcgcgacctgggcccagaacatcctcaccgccatccagcaggtccggtccctgatcggggacgaggagttcctggactacatgcccagcatgaagcgcttccggaaggaggaggagtccgagggcgccatctggtga

SEQ ID NO: 10319 - RNA, 9873 nt, synthetic construct
  misc_feature 1..9873: note = derived and/or modified CDS sequence (opt1) from DENV-3__FJ562102__SS-prME
  source 1..9873: mol_type = other RNA
accagcctgtgcctcatgatgatgctgcccgcgaccctggccttccacctcacgagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccttcatcatgatcggcagcaacgcctccgaccggatggggatgggcgtcacctacctcgccctgatcgccaccttcaagatccagcccttcctggcgctcgggttcttcctgcgcaagctgacgagccgggagaacctcctgctgggcgtgggcctcgccatggccaccaccctgcagctgcccgaggacatcgagcagatggccaacgggatcgcgctcggcctgatgaccctgaagctcatcacgcagttcgagacctaccagctgtggaccgccctggtgagcctgacctgctccaacacgatcttcaccctgaccgtcgcctggcgcaccgccacgctgatcctcgccggggtgagcctgctgccgctctgccagtccagctccatgcggaagaccgactggctgcccatgaccgtcgcggccatgggcgtgccgcccctccccctcttcatcttcagcctgaaggacacccccaagcgccgctcctggcccctgaacgagggggtgatggccgtcggcctcgtgagcatcctggcctccagcctgctccggaacgacgtgcccatggccggcccgctggtcgccggcgggctgctcatcgcctgctacgtgatcacggggacctccgccgacctgaccgtggagaaggccgccgacgtcacctgggaggaggaggcggagcagacgggggtgagccacaacctgatgatcaccgtggacgacgacgggaccatgcgcatcaaggacgacgagaccgagaacatcctcaccgtcctgctgaagacggccctcctgatcgtgtccggcatcttcccctacagcatccccgccaccctgctcgtgtggcacacctggcagaagcagacccagcggtccggcgtcctgtgggacgtgcccagcccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgcacaacgggaagcgcctggagcccaactgggcgtccgtcaagaaggacctgatcagctacggcgggggctggcggctctccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctggaggaggagatgttcaagaagcggaacctcaccatcatggacctgcacccggggagcggcaagacccgcaagtacctgcccgccatcgtccgggaggccatcaagcgccggctccgcaccctgatcctggcgcccacgcgggtggtggccgccgagatggaggaggccctcaaggggctgcccatccgctaccagaccaccgccaccaagtccgagcacacgggccgggagatcgtcgacctgatgtgccacgcgaccttcaccatgcgcctcctgagcccggtgcgggtgcccaactacaacctgatcatcatggacgaggcccacttcaccgaccccgcctccatcgccgcccgcgggtacatcagcacgcgggtcggcatgggcgaggcggccgccatcttcatgaccgccacgcccccggggaccgcggaggccttcccccagtccaacgcccccatccaggacgaggagcgcgacatccccgagcgcagctggaactccggcaacgagtggatcacggacttcgtggggaagaccgtgtggttcgtcccgagcatcaaggccggcaacgacatcgccaactgcctccggaagaacgggaagaaggtgatccagctgtcccgcaagaccttcgacaccgagtaccagaagacgcggctgaacgactgggacttcgtggtcaccaccgacatcagcgagatgggcgcgaacttcaaggccgaccgcgtgatcgacccccggcgctgcctcaagcccgtgatcctgaccgacggccccgagcgggtcatcctggccgggccgatgcccgtgacggccgcctccgcggcccagcgccggggccgcgtggggcggaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgcgagaagtccgcggccatcgacggcgagtaccggctgaagggcgagtcccgcaagaccttcgtcgagctgatgcggcgcggggacctccccgtgtggctggcccacaaggtcgccagcgagggcatcaagtacacggaccggaagtggtgcttcgacggggagcgcaacaaccagatcctggaggagaacatggacgtggagatctggaccaaggagggcgagcggaagaagctccgcccgcgctggctggacgcgcggacctactccgaccccctggccctcaaggagttcaaggacttcgccgccggccgcaagagcatcgccctggacctggtgaccgagatcgggcgggtcccctcccacctcgcgtaccgcacgcggaacgccctggacaacctggtgatgctccacaccagcgagcacggcgggcgcgcctaccggcacgccgtggaggagctgccggagaccatggagaccctgctcctgctgggcctcatgatcctgctgaccgggggcgccatgctgttcctgatcagcggcaaggggatcggcaagacctccatcgggctgatctgcgtcatcgtgagctccggcatgctctggatggcggacgtgcccctgcagtggatcgccagcgccatcatcctggagttcttcatgatggtcctcctgatccccgagcccgagaagcagcgcaccccgcaggacaaccagctggcctacgtggtgatcgggatcctcaccctggccgcgatcgtcgccgccaacgagatgggcctgctcgagacgaccaagcgggacctgggcatgtccaaggagcccggggtggtgagccccacctcctacctggacgtcgacctccaccccgccagcgcctggaccctgtacgcggtggccacgaccgtgatcaccccgatgctgcgccacaccatcgagaactccacggccaacgtcagcctcgccgcgatcgccaaccaggccgtggtgctgatgggcctggacaaggggtggcccatctccaagatggacctcggcgtccccctgctggccctcgggtgctacagccaggtgaaccccctgaccctgaccgccgcggtgctcctgctggtcacccactacgccatcatcggcccgggcctccaggccaaggccacgcgggaggcccagaagcgcaccgcggccgggatcatgaagaaccccaccgtggacggcatcatgaccatcgacctggaccccgtgatctacgactccaagttcgagaagcagctggggcaggtcatgctcctggtgctgtgcgccgtgcagctcctgctgatgcggacgagctgggccctctgcgaggccctgaccctggcgaccggccccatcaccacgctctgggagggctccccggggaagttctggaacaccaccatcgccgtcagcatggccaacatcttccgcggctcctacctggccggggcgggcctggccttcagcatcatgaagtccgtggggaccggccggcgcggcacggggagccagggcgagaccctcggggagaagtggaagaagaagctgaaccagctgagccggaaggagttcgacctctacaagaagtccggcatcaccgaggtggaccgcaccgaggccaaggaggggctgaagcggggcgagaccacgcaccacgccgtcagccgcggctccgccaagctgcagtggttcgtggagcggaacatggtgatccccgaggggcgcgtcatcgacctcggctgcgggcgcggcgggtggagctactactgcgcgggcctgaagaaggtgaccgaggtgcggggctacaccaagggcggccccgggcacgaggagcccgtcccgatgtccacctacggctggaacctggtgaagctcatgagcgggaaggacgtgttctacctgccgcccgagaagtgcgacacgctgctgtgcgacatcggcgagtccagcccctccccgaccgtcgaggagagccgcaccatccgggtgctcaagatggtggagccctggctgaagaacaaccagttctgcatcaaggtcctgaacccctacatgcccaccgtgatcgagcacctcgagcgcctgcagcggaagtacggcgggatgctggtgcgcaacccgctctcccggaacagcacgcacgagatgtactggatctccaacggcaccgggaacatcgtcagctccgtgaacatggtgagccgcctgctgctcaaccggttcaccatgacccaccgccggcccacgatcgagaaggacgtcgacctgggcgccggcacccgccacgtgaacgccgagcccgagaccccgaacatggacgtcatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtggtcaagctgctcaccaagccctgggacgtggtgcccatggtcacccagatggccatgacggacaccaccccgttcgggcagcagcgggtgttcaaggagaaggtggacacccgcacgccccggcccatgcccggcacccgcaaggtcatggagatcaccgccgagtggctgtggcggaccctgggccgcaacaagaagccgcgcctctgcacgcgggaggagttcaccaagaaggtgcgcaccaacgccgccatgggggcggtgttcaccgaggagaaccagtgggacagcgcccgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgcggacgacacggccggctgggacacccggatcaccgaggacgacctccacaacgaggagaagatcacccagcagatggaccccgagcaccgccagctggccaacgccatcttcaagctgacgtaccagaacaaggtggtgaaggtccagcggcccaccccgaaggggaccgtgatggacatcatctcccgcaaggaccagcggggcagcggccaggtggggacctacggcctcaacaccttcacgaacatggaggcccagctggtccgccagatggagggggagggcgtgctgtccaaggcggacctcgagaacccccacctcctggagaagaagatcacccagtggctcgagaccaagggggtggagcggctgaagcgcatggccatcagcggcgacgactgcgtcgtgaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtggtgccctgccgcccccaggacgagctgatcgggcgcgcgcggatctcccagggcgccgggtggagcctgaaggagaccgcctgcctcggcaaggcctacgcccagatgtggtccctgatgtacttccaccgccgggacctgcgcctcgcgagcaacgccatctgctccgccgtcccggtgcactggatccccacgagccggaccacctggagcatccacgcccaccaccagtggatgaccacggaggacatgctgaccgtgtggaaccgcgtctggatcgaggacaacccctggatggaggacaagacccccgtgaccacgtgggaggacgtgccgtacctgggcaagcgggaggaccagtggtgcgggtccctcatcggcctgaccagccgcgcgacctgggcccagaacatcctgaccgccatccagcaggtccggtccctcatcggggacgaggagttcctggactacatgcccagcatgaagcgcttccggaaggaggaggagtccgagggcgccatctggtga

SEQ ID NO: 10320 - RNA, 9873 nt, synthetic construct
  misc_feature 1..9873: note = derived and/or modified CDS sequence (opt1) from DENV-3__FJ410229__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccggtgcgggtgcccaactacaacctcatcatcatggacgaggcccacttcaccgaccccgcctccatcgccgcccgcgggtacatcagcacgcgggtcggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtggggaagaccgtgtggttcgtccccagcatcaaggccggcaacgacatcgccaactgcctgcggaagaacgggaagaaggtgatccagctgtcccgcaagaccttcgacaccgagtaccagaagacgcggctcaacgactgggacttcgtggtcaccaccgacatcagcgagatgggcgcgaacttcaaggccgaccgcgtgatcgacccccggcgctgcctgaagcccgtgatcctgaccgacggccccgagcgggtcatcctcgccgggccgatgcccgtgacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgtaccgcacgcggaacgccctggacaacctcgtgatgctgcacaccagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacctccatcgggctcatctgcgtcatcgtgagctccggcatgctgtggatggcggacgtgcccctgcagtggatcgccagcgccatcatcctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacctacggctggaacctcgtgaagctgatgagcgggaaggacgtgttctacctgccgcccgagaagtgcgacacgctgctctgcgacatcggcgagtccagcccctccccgaccgtcgaggagagccgcaccatccgggtgctgaagatggtggagccctggctgaagaacaaccagttctgcatcaaggtcctcaacccctacatgcccaccgtgatcgagcacctggagcgcctgcagcggaagtacggcgggatgctcgtgcgcaacccgctgtcccggaacagcacgcacgagatgtactggatctccaacggcaccgggaacatcgtcagctccgtgaacatggtgagccgcctgctcctgaaccggttcaccatgacccaccgccggcccacgatcgagaaggacgtcgacctgggcgccggcacccgccacgtgaacgccgagcccgagaccccgaacatggacgtcatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtggtcaagctcctgaccaagccctgggacgtggtgcccatggtcacccagatggccatgacggacaccaccccgttcgggcagcagcgggtgttcaaggagaaggtggacacccgcacgccccggcccatgcccggcacccgcaaggtcatggagatcaccgccgagtggctgtggcggaccctcggccgcaacaagaagccgcgcctgtgcacgcgggaggagttcaccaagaaggtgcgcaccaacgccgccatgggggcggtgttcaccgaggagaaccagtgggacagcgcccgggccgccgtcgaggacgaggagttctggaagctggtggaccgcgagcgggagctccacaagctgggcaagtgcgggtcctgcgtgtacaacatgatgggcaagcgcgagaagaagctgggggagttcggcaaggcgaagggcagccgggccatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggccatgtacgcggacgacacggccggctgggacacccggatcaccgaggacgacctgcacaacgaggagaagatcacccagcagatggaccccgagcaccgccagctggccaacgccatcttcaagctcacgtaccagaacaaggtggtgaaggtccagcggcccaccccgaaggggaccgtgatggacatcatctcccgcaaggaccagcggggcagcggccaggtggggacctacggcctgaacaccttcacgaacatggaggcccagctggtccgccagatggagggggagggcgtgctctccaaggcggacctggagaacccccacctcctcgagaagaagatcacccagtggctggagaccaagggggtggagcggctgaagcgcatggccatcagcggcgacgactgcgtcgtgaagcccatcgacgaccggttcgccaacgccctcctggccctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcgcggatctcccagggcgccgggtggagcctcaaggagaccgcctgcctgggcaaggcctacgcccagatgtggtccctgatgtacttccaccgccgggacctccgcctggcgagcaacgccatctgctccgccgtcccggtgcactggatccccacgagccggaccacctggagcatccacgcccaccaccagtggatgaccacggaggacatgctgaccgtgtggaaccgcgtctggatcgaggacaacccctggatggaggacaagacccccgtgaccacgtgggaggacgtgccgtacctcggcaagcgggaggaccagtggtgcgggtccctgatcggcctgaccagccgcgcgacctgggcccagaacatcctcaccgccatccagcaggtccggtccctgatcggggacgaggagttcctggactacatgcccagcatgaagcgcttccggaaggaggaggagtccgagggcgccatctggtga

SEQ ID NO: 10321 - RNA, 9873 nt, synthetic construct
  misc_feature 1..9873: note = derived and/or modified CDS sequence (opt1) from DENV-3__FJ461326__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatctccaccagcctgacccagaaggtggtgatcttcatcctgctcatgctggtcacgccctccatgaccatgcggtgcgtgggcgtggggaaccgcgacttcgtcgagggcctgagcggcgccacctgggtggacgtggtcctcgagcacgggggctgcgtgaccacgatggcccggaacaagcccaccctggacatcgagctgcagaagaccgaggccacccagctcgcgacgctgcgcaagctgtgcatcgaggggaagatcaccaacatcaccaccgactcccggtgccccacgcagggcgaggccatcctcccggaggagcaggaccagaactacgtgtgcaagcacacctacgtcgaccgcggctgggggaacggctgcgggctgttcggcaaggggagcctggtgacctgcgccaagttccagtgcctcgagcccatcgagggcaaggtggtccagtacgagaacctgaagtacaccgtgatcatcacggtgcacaccggcgaccagcaccaggtcgggaacgacacccagggcgtgaccgtcgagatcacgccccaggcctccaccgtggaggccgtgctgcccgagtacgggaccctcggcctggagtgcagcccgcggaccgggctggacttcaacgagatgatcctcctgaccatgaagaacaaggcgtggatggtccaccgccagtggttcttcgacctgcccctcccctggacgtccggcgccaccaccgagacccccacgtggaaccggaaggagctgctggtgaccttcaagaacgcccacgccaagaagcaggaggtggtcgtgctcggcagccaggagggggccatgcacaccgcgctgaccggcgccacggagatccagaactccgggggcaccagcatcttcgccgggcacctgaagtgccgcctcaagatggacaagctggagctgaagggcatgtcctacgccatgtgcctcaacaccttcgtgctgaagaaggaggtcagcgagacccagcacggcacgatcctgatcaaggtggagtacaagggggaggacgccccgtgcaagatccccttcagcaccgaggacggccaggggaaggcgcacaacggccggctgatcaccgccaaccccgtggtcaccaagaaggaggagcccgtgaacatcgaggccgagccgcccttcggcgagtccaacatcgtgatcgggatcggcgacaaggccctcaagatcaactggtacaagaaggggagctccatcggcaagatgttcgaggcgacggcccgcggggcccggcgcatggccatcctgggcgacaccgcctgggacttcggcagcgtcgggggcgtgctgaactccctcgggaagatggtgcaccagatcttcggcagcgcgtacaccgccctgttctccggggtcagctggatcatgaagatcggcatcggcgtgctgctcacctggatcgggctgaactccaagaacacgagcatgtccttcagctgcatcgtgatcggcatcatcaccctgtacctcggggccgtcgtgcaggccgacatgggctgcgccatcaactggaaggggaaggagctgaagtgcggctccggcatcttcgtgaccaacgaggtccacacctggacggagcagtacaagttccaggcggacagccccaagcgcctggccaccgccatcgccggggcctgggagaacggcgtgtgcgggatccggtccaccacccgcatggagaacctcctgtggaagcagatcgcgaacgagctgaactacatcctctgggagaacaacatcaagctgacggtggtcgtgggcgacatcatcggggtgctggagcagggcaagcggaccctcacgccccagccgatggagctgaagtacagctggaagacctggggcaaggccaagatcgtcacggccgagacccagaactccagcttcatcatcgacgggcccaacacccccgagtgcccctccgccagccgcgcgtggaacgtgtgggaggtggaggactacggcttcggggtcttcaccacgaacatctggctgaagctccgggaggtgtacacccagagctgcgaccaccgcctgatgtccgccgccatcaaggacgagcgggccgtgcacgccgacatgggctactggatcgagagccagaagaacggctcctggaagctggagaaggcgagcttcatcgaggtcaagacctgcacctggccgaagtcccacaccctctggagcaacggggtgctggagtccgacatgatcatccccaagagcctggccggccccatctcccagcacaaccaccgcccggggtaccacacgcagaccgccggcccctggcacctcgggaagctggagctggacttcaactactgcgagggcaccaccgtggtcatcacggagaactgcggcacccgggggcccagcctccgcaccaccacggtgtccggcaagctgatccacgagtggtgctgccggagctgcaccctgcccccgctccgctacatgggggaggacggctgctggtacgggatggagatccggcccatcaacgagaaggaggagaacatggtgaagtccctggtcagcgccggctccggcaaggtggacaacttcaccatgggggtgctgtgcctcgccatcctgttcgaggaggtcatgcgcggcaagttcgggaagaagcacatgatcgcgggcgtgctgttcaccttcgtgctcctgctgagcgggcagatcacgtggcgggacatggcccacaccctcatcatgatcggctccaacgccagcgaccgcatgggcatgggggtcacctacctggccctgatcgccaccttcaagatccagcccttcctcgcgctgggcttcttcctgcggaagctcacgagccgcgagaacctgctgctcggggtgggcctggccatggccaccaccctgcagctccccgaggacatcgagcagatggccaacggcatcgcgctggggctgatgaccctcaagctgatcacgcagttcgagacctaccagctgtggaccgccctcgtgtccctgacctgcagcaacacgatcttcaccctgaccgtcgcctggcggaccgccacgctcatcctggccggcgtgtccctgctcccgctgtgccagagctccagcatgcgcaagaccgactggctgcccatgaccgtcgcggccatgggggtgccgcccctgccgctgttcatcttctccctgaaggacacccccaagcgccggagctggcccctcaacgagggcgtgatggccgtcgggctggtgtccatcctggccagctccctcctgcgcaacgacgtgcccatggccggcccgctggtcgcgggcgggctcctgatcgcctgctacgtgatcacgggcaccagcgccgacctgaccgtggagaaggccgccgacgtcacctgggaggaggaggcggagcagacgggggtgtcccacaacctcatgatcaccgtggacgacgacggcaccatgcggatcaaggacgacgagaccgagaacatcctgaccgtcctgctcaagacggccctgctgatcgtgagcgggatcttcccctactccatccccgccaccctcctggtgtggcacacctggcagaagcagacccagcgcagcggcgtcctgtgggacgtgccctccccgcccgagacgcagaaggccgagctcgaggagggcgtgtaccggatcaagcagcaggggatcttcggcaagacccaggtcggggtgggcgtgcagaaggagggggtcttccacaccatgtggcacgtgacccgcggcgccgtgctgacgcacaacggcaagcggctggagcccaactgggcgagcgtcaagaaggacctcatctcctacgggggcgggtggcgcctgagcgcccagtggcagaagggcgaggaggtccaggtgatcgccgtcgagcccgggaagaacccgaagaacttccagaccatgcccggcatcttccagaccaccacgggcgagatcggggccatcgcgctggacttcaagcccggcaccagcgggtccccgatcatcaaccgggagggcaaggtggtgggcctgtacgggaacggcgtcgtgaccaagaacgggggctacgtgagcgggatcgcccagaccaacgccgagcccgacggccccacgcccgagctcgaggaggagatgttcaagaagcgcaacctgaccatcatggacctgcacccgggctccgggaagacccggaagtacctccccgccatcgtccgcgaggccatcaagcggcgcctgcggaccctgatcctcgcgcccacgcgcgtggtggccgccgagatggaggaggccctgaagggcctgcccatccggtaccagaccaccgccaccaagagcgagcacacggggcgcgagatcgtcgacctcatgtgccacgcgaccttcaccatgcggctgctgtccccggtgcgcgtgcccaactacaacctcatcatcatggacgaggcccacttcaccgaccccgccagcatcgccgcccggggctacatctccacgcgcgtcgggatgggcgaggcggccgccatcttcatgaccgccacgccgcccggcaccgcggaggccttcccccagagcaacgcccccatccaggacgaggagcgcgacatccccgagcggtcctggaacagcgggaacgagtggatcacggacttcgtgggcaagaccgtgtggttcgtcccctccatcaaggccgggaacgacatcgccaactgcctgcgcaagaacggcaagaaggtgatccagctgagccggaagaccttcgacaccgagtaccagaagacgcgcctcaacgactgggacttcgtggtcaccaccgacatctccgagatgggggcgaacttcaaggccgaccgggtgatcgacccccgccggtgcctgaagcccgtgatcctgaccgacggccccgagcgcgtcatcctcgccggcccgatgcccgtgacggccgccagcgcggcccagcggcgcgggcgggtgggccgcaacccccagaaggagaacgaccagtacatcttcaccgggcagcccctgaacaacgacgaggaccacgcccactggaccgaggccaagatgctgctcgacaacatcaacaccccggagggcatcatccccgccctgttcgagcccgagcgggagaagtccgcggccatcgacggggagtaccgcctgaagggcgagagccggaagaccttcgtcgagctcatgcgccggggcgacctgcccgtgtggctggcccacaaggtcgcctccgaggggatcaagtacacggaccgcaagtggtgcttcgacggcgagcggaacaaccagatcctcgaggagaacatggacgtggagatctggaccaaggagggggagcgcaagaagctgcgcccgcggtggctggacgcgcgcacctacagcgaccccctcgccctgaaggagttcaaggacttcgccgccggccggaagtccatcgccctggacctcgtgaccgagatcggccgcgtccccagccacctggcgtaccggacgcgcaacgccctggacaacctcgtgatgctgcacaccagcgagcacgggggccgggcctaccgccacgccgtggaggagctgccggagaccatggagaccctcctgctgctcgggctgatgatcctgctcacgggcggggccatgctgttcctgatctccggcaagggcatcgggaagaccagcatcggcctcatctgcgtcatcgcgtccagcgggatgctgtggatggccgacgtgcccctgcagtggatcgcctccgccatcatcctcgagttcttcatgatggtgctgctgatccccgagcccgagaagcagcggaccccgcaggacaaccagctcgcctacgtcgtgatcggcatcctgaccctggcggccatcgtggccgccaacgagatggggctcctggagacgaccaagcgcgacctgggcatgagcaaggagcccggcgtcgtgtcccccaccagctacctcgacgtggacctgcaccccgcctccgcgtggaccctgtacgccgtcgccacgaccgtgatcaccccgatgctccggcacaccatcgagaacagcacggccaacgtgtccctggcggccatcgccaaccaggccgtcgtgctgatggggctcgacaagggctggcccatcagcaagatggacctgggggtgcccctgctcgccctgggctgctactcccaggtcaaccccctgaccctcaccgcggccgtgctgctgctcgtgacccactacgccatcatcgggccgggcctgcaggccaaggccacgcgcgaggcgcagaagcggaccgccgccggcatcatgaagaaccccaccgtcgacgggatcatgaccatcgacctggaccccgtgatctacgacagcaagttcgagaagcagctcggccaggtgatgctgctggtcctctgcgccgtgcagctgctgctcatgcgcacgtcctgggccctgtgcgaggcgctgaccctcgccaccgggcccatcaccacgctgtgggagggcagcccgggcaagttctggaacaccaccatcgccgtgtccatggccaacatcttccgggggagctacctggcgggcgccgggctcgccttctccatcatgaagtccgtcggcaccgggcgccggggcacgggcagccagggggagaccctgggcgagaagtggaagaagaagctgaaccagctctcccgcaaggagttcgacctgtacaagaagtccgggatcaccgaggtggaccggaccgaggccaaggagggcctgaagcgcggggagaccacgcaccacgccgtgtcccggggcagcgcgaagctccagtggttcgtcgagcgcaacatggtgatccccgagggccgcgtgatcgacctggggtgcggccgcgggggctggtcctactactgcgccgggctgaagaaggtcaccgaggtgcgcggctacaccaagggcgggcccggccacgaggagcccgtgccgatgagcacctacgggtggaacctcgtcaagctgatgtccggcaaggacgtgttctacctgccgcccgagaagtgcgacacgctgctctgcgacatcggggagagctcccccagcccgaccgtggaggagtcccggaccatccgcgtcctgaagatggtggagccctggctgaagaacaaccagttctgcatcaaggtgctcaacccctacatgcccaccgtcatcgagcacctggagcggctgcagcgcaagtacggcggcatgctcgtgcggaacccgctgagccgcaactccacgcacgagatgtactggatcagcaacgggaccggcaacatcgtgtccagcgtcaacatggtgtcccggctgctcctgaaccgcttcaccatgacccaccggcgccccacgatcgagaaggacgtggacctgggggccggcacccggcacgtcaacgccgagcccgagaccccgaacatggacgtgatcggcgagcgcatcaagcggatcaaggaggagcacagctccacctggcactacgacgacgagaacccctacaagacgtgggcctaccacgggagctacgaggtcaaggcgaccggcagcgcctccagcatgatcaacggggtggtgaagctcctgaccaagccctgggacgtcgtgcccatggtgacccagatggccatgacggacaccaccccgttcggccagcagcgcgtcttcaaggagaaggtggacacccggacgccccgccccatgcccgggacccggaaggtgatggagatcaccgccgagtggctgtggcgcaccctcggccgcaacaagaagccgcggctgtgcacgcgcgaggagttcaccaagaaggtccggaccaacgccgcgatgggcgccgtgttcaccgaggagaaccagtgggactccgcccgcgccgcggtggaggacgaggagttctggaagctggtcgaccgggagcgcgagctccacaagctggggaagtgcggcagctgcgtgtacaacatgatggggaagcgggagaagaagctgggcgagttcgggaaggccaagggctcccgcgccatctggtacatgtggctcggcgcccggtacctggagttcgaggccctggggttcctcaacgaggaccactggttcagccgcgagaactcctacagcggcgtggagggggagggcctgcacaagctggggtacatcctccgggacatctccaagatccccggcggcgcgatgtacgccgacgacacggccgggtgggacacccgcatcaccgaggacgacctgcacaacgaggagaagatcacccagcagatggaccccgagcaccggaagctggccaacgccatcttcaagctcacgtaccagaacaaggtcgtgaaggtgcagcgccccaccccgaagggcaccgtcatggacatcatcagccggaaggaccagcgcgggtccggccaggtgggcacctacgggctgaacaccttcacgaacatggaggcgcagctggtgcggcagatggagggcgagggggtcctcagcaaggccgacctggagaacccccacctcctcgagaagaagatcacccagtggctggagaccaagggcgtggagcgcctgaagcggatggccatctccggggacgactgcgtggtcaagcccatcgacgaccgcttcgccaacgccctcctggcgctgaacgacatgggcaaggtgcggaaggacatcccccagtggcagccgagcaagggctggcacgactggcagcaggtccccttctgctcccaccacttccacgagctcatcatgaaggacgggcgcaagctggtcgtgccctgccgcccccaggacgagctgatcggccgggcccgcatcagccagggggccggctggtccctcaaggagaccgcctgcctggggaaggcctacgcgcagatgtggagcctgatgtacttccaccggcgcgacctccggctggcctccaacgccatctgcagcgccgtgccggtccactggatccccacgagccgcaccacctggtccatccacgcgcaccaccagtggatgaccacggaggacatgctgaccgtgtggaaccgggtgtggatcgaggacaacccctggatggaggacaagacccccgtcaccacgtgggaggacgtgccgtacctcggcaagcgcgaggaccagtggtgcggcagcctgatcgggctgacctcccgggccacctgggcccagaacatcctcaccgccatccagcaggtccgcagcctgatcggcgacgaggagttcctggactacatgccctccatgaagcggttccgcaaggaggaggagagcgagggggccatctggtga

SEQ ID NO: 10322 - RNA, 9873 nt, synthetic construct
  misc_feature 1..9873: note = derived and/or modified CDS sequence (opt1) from DENV-3__FJ461329__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggaggactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccggtgcgggtgcccaactacaacctcatcatcatggacgaggcccacttcaccgaccccgcctccatcgccgcccgcgggtacatcagcacgcgggtcggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtggggaagaccgtgtggttcgtccccagcatcaaggccggcaacgacatcgccaactgcctgcggaagaacgggaagaaggtgatccagctgtcccgcaagaccttcgacaccgagtaccagaagacgcggctcaacgactgggacttcgtggtcaccaccgacatcagcgagatgggcgcgaacttcaaggccgaccgcgtgatcgacccccggcgctgcctgaagcccgtgatcctgaccgacggccccgagcgggtcatcctcgccgggccgatgcccgtgacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtcgccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtcccctcccacctggcgtaccgcacgcggaacgccctggacaacctcgtgatgctgcacaccagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacctccatcgggctcatctgcgtcatcgtgagctccggcatgctgtggatggcggacatccccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacctacggctggaacctcgtgaagctgatgagcgggaaggacgtgttctacctgccgcccgagaagtgcgacacgctgctctgcgacatcggcgagtccagcccctccccgaccgtcgaggagagccgcaccatccgggtgctgaagatggtggagccctggctgaagaacaaccagttctgcatcaaggtcctcaacccctacatgcccaccgtgatcgagcacctggagcgcctgcagcggaagtacggcgggatgctcgtgcgcaacccgctgtcccggaacagcacgcacgagatgtactggatctccaacggcaccgggaacatcgtcagctccgtgaacatggtgagccgcctgctcctgaaccggttcaccatgacccaccgccggcccacgatcgagaaggacgtcgacctgggcgccggcacccgccacgtgaacgccgagcccgagaccccgaacatggacgtcatcggggagcggatcaagcgcatcaaggaggagcactccagcacctggcactacgacgacgagaacccctacaagacgtgggcctaccacggctcctacgaggtgaaggccaccgggagcgcgagctccatgatcaacggcgtggtcaagctcctgaccaagccctgggacgtggtgcccatggtcacccagatggccatgacggacaccaccccgttcgggcagcagcgggtgttcaaggagaaggtggacacccgcacgccccggcccatgcccggcacccgcaaggtcatggagatcaccgccgagtggctgtggcggaccctcggccgcaacaagaagccgcgcctgtgcacgcgggaggagttcaccaagaaggtgcgcaccaacgccgccatgggggcggtgttcaccgaggagaaccagtgggacagcgcccgggccgccgtcgaggacgaggagttctggaagctggtggaccgcgagcgggagctccacaagctgggcaagtgcgggtcctgcgtgtacaacatgatgggcaagcgcgagaagaagctgggggagttcggcaaggcgaagggcagccgggccatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggccatgtacgcggacgacacggccggctgggacacccggatcaccgaggacgacctgcacaacgaggagaagatcacccagcagatggaccccgagcaccgccagctggccaacgccatcttcaagctcacgtaccagaacaaggtggtgaaggtccagcggcccaccccgaaggggaccgtgatggacatcatctcccgcaaggaccagcggggcagcggccaggtggggacctacggcctgaacaccttcacgaacatggaggcccagctggtccgccagatggagggggagggcgtgctctccaaggcggacctggagaacccccacctcctcgagaagaagatcacccagtggctggagaccaagggggtggagcggctgaagcgcatggccatcagcggcgacgactgcgtcgtgaagcccatcgacgaccggttcgccaacgccctcctggccctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcgcggatctcccagggcgccgggtggagcctcaaggagaccgcctgcctgggcaaggcctacgcccagatgtggtccctgatgtacttccaccgccgggacctccgcctggcgagcaacgccatctgctccgccgtcccggtgcactggatccccacgagccggaccacctggagcatccacgcccaccaccagtggatgaccacggaggacatgctgaccgtgtggaaccgcgtctggatcgaggacaacccctggatggaggacaagacccccgtgaccacgtgggaggacgtgccgtacctcggcaagcgggaggaccagtggtgcgggtccctgatcggcctgaccagccgcgcgacctgggcccagaacatcctcaccgccatccagcaggtccggtccctgatcgggaacgaggagttcctggactacatgcccagcatgaagcgcttccggaaggaggaggagtccgagggcgccatctggtga

SEQ ID NO: 10323 - RNA, 9873 nt, synthetic construct
  misc_feature 1..9873: note = derived and/or modified CDS sequence (opt1) from DENV-3__KF955459__SS-prME
  source 1..9873: mol_type = other RNA
accagcctgtgcctcatgatgatgctgcccgccaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcgcgacccggatggagaacctcctgtggaagcagatcgccaacgagctgaactacatcctctgggagaacaacatcaagctgaccgtggtcgtgggggacatcatcggcgtgctggagcagggcaagcgcacgctcacgccccagccgatggagctgaagtactcctggaagacctgggggaaggccaagatcgtcaccgccgagacgcagaacagctccttcatcatcgacggccccaacacccccgagtgccccagcgcgtcccgggcctggaacgtgtgggaggtggaggactacgggttcggcgtcttcaccaccaacatctggctgaagctccgcgaggtgtacacgcagagctgcgaccaccggctgatgagcgccgccatcaaggacgagcgcgccgtgcacgcggacatgggctactggatcgagtcccagaagaacgggagctggaagctggagaaggcctccttcatcgaggtcaagacctgcacctggcccaagagccacaccctctggtccaacggcgtgctggagagcgacatgatcatccccaagtccctggccgggcccatcagccagcacaaccaccggccgggctaccacacccagacggccgggccctggcacctcggcaagctggagctggacttcaactactgcgagggcaccaccgtggtcatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgctgttcaccttcgtgctcctgctgtccggccagatcacctggcgcgacatggcccacacgctcatcatgatcggcagcaacgcctccgaccggatggggatgggcgtcacctacctggccctgatcgcgaccttcaagatccagcccttcctcgccctggggttcttcctgcgcaagctcaccagccgggagaacctgctgctcggcgtgggcctggccatggccacgaccctgcagctccccgaggacatcgagcagatggcgaacgggatcgccctgggcctgatgaccctcaagctgatcacccagttcgagacgtaccagctgtggaccgccctcgtgagcctgacctgctccaacaccatcttcacgctgaccgtcgcctggcgcaccgccaccctcatcctggcgggggtgagcctgctcccgctgtgccagtccagctccatgcggaagacggactggctgcccatgaccgtcgccgccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggcgggcccgctggtcgccgggggcctcctgatcgcctgctacgtgatcaccgggacgtccgccgacctgaccgtggagaaggccgcggacgtcacctgggaggaggaggccgagcagaccggcgtgagccacaacctcatgatcacggtggacgacgacgggaccatgcgcatcaaggacgacgagaccgagaacatcctgaccgtcctgctcaagaccgccctgctgatcgtgtccggcatcttcccctacagcatccccgccacgctcctggtgtggcacacctggcagaagcagacccagcggtccggcgtcctgtgggacgtgcccagcccgcccgagacccagaaggccgagctcgaggagggggtgtaccgcatcaagcagcagggcatcttcgggaagacgcaggtcggcgtgggggtgcagaaggagggcgtcttccacaccatgtggcacgtgacccggggcgcggtgctgacccacaacgggaagcgcctggagcccaactgggcctccgtcaagaaggacctcatcagctacggcgggggctggcggctgtccgcccagtggcagaagggggaggaggtccaggtgatcgccgtcgagcccggcaagaacccgaagaacttccagacgatgcccggcatcttccagaccaccaccggggagatcggcgcgatcgccctggacttcaagcccgggacgagcggcagcccgatcatcaaccgcgagggcaaggtggtggggctgtacggcaacggggtcgtgaccaagaacggcgggtacgtgtccggcatcgcccagaccaacgccgagcccgacggccccacccccgagctcgaggaggagatgttcaagaagcggaacctgacgatcatggacctgcacccggggagcggcaagacccgcaagtacctccccgccatcgtccgggaggcgatcaagcgccggctgcgcaccctgatcctcgcccccacccgggtggtggccgccgagatggaggaggccctgaaggggctgcccatccgctaccagacgaccgcgaccaagtccgagcacaccggccgggagatcgtcgacctcatgtgccacgccacgttcaccatgcgcctgctgagcccggtgcgggtgcccaactacaacctcatcatcatggacgaggcccacttcaccgaccccgcctccatcgccgcgcgcgggtacatcagcacccgggtcggcatgggcgaggccgccgccatcttcatgacggcgacgccgcccgggaccgccgaggccttcccccagtccaacgcccccatccaggacgaggagcgcgacatccccgagcgcagctggaactccggcaacgagtggatcaccgacttcgtggggaagacggtgtggttcgtccccagcatcaaggccggcaacgacatcgcgaactgcctgcggaagaacgggaagaaggtgatccagctgtcccgcaagaccttcgacaccgagtaccagaagacccggctcaacgactgggacttcgtggtcacgaccgacatcagcgagatgggcgccaacttcaaggccgaccgcgtgatcgacccccggcgctgcctgaagcccgtgatcctgaccgacggccccgagcgggtcatcctcgccgggccgatgcccgtgaccgccgcgtccgccgcccagcgccggggccgcgtggggcggaacccccagaaggagaacgaccagtacatcttcacgggccagcccctgaacaacgacgaggaccacgcccactggaccgaggccaagatgctgctcgacaacatcaacaccccggaggggatcatccccgcgctgttcgagcccgagcgcgagaagtccgccgccatcgacggcgagtaccggctgaagggcgagtcccgcaagaccttcgtcgagctcatgcggcgcggggacctgcccgtgtggctggcccacaaggtcgcgagcgagggcatcaagtacaccgaccggaagtggtgcttcgacggggagcgcaacaaccagatcctcgaggagaacatggacgtggagatctggacgaaggagggcgagcggaagaagctgcgcccgcgctggctggacgcccggacctactccgaccccctcgccctgaaggagttcaaggacttcgccgccggccgcaagagcatcgcgctggacctcgtgaccgagatcgggcgggtcccctcccacctggcctaccgcacccggaacgccctggacaacctcgtgatgctgcacacgagcgagcacggcgggcgcgcctaccggcacgccgtggaggagctgccggagaccatggagaccctcctgctgctcggcctgatgatcctgctcaccgggggcgcgatgctgttcctgatcagcggcaaggggatcggcaagacgtccatcgggctcatctgcgtcatcgtgagctccggcatgctgtggatggccgacgtgcccctgcagtggatcgccagcgccatcatcctcgagttcttcatgatggtcctgctgatccccgagcccgagaagcagcgcaccccgcaggacaaccagctcgcctacgtggtgatcgggatcctgaccctggcggccatcgtcgccgccaacgagatgggcctcctggagaccacgaagcgggacctgggcatgtccaaggagcccggggtggtgagccccacctcctacctcgacgtcgacctgcaccccgccagcgcgtggaccctgtacgccgtggccaccacggtgatcaccccgatgctccgccacaccatcgagaactccaccgccaacgtcagcctggcggccatcgccaaccaggccgtggtgctgatgggcctcgacaaggggtggcccatctccaagatggacctgggcgtccccctgctcgccctggggtgctacagccaggtgaaccccctgacgctcaccgcggccgtgctgctgctcgtcacccactacgccatcatcggcccgggcctgcaggccaaggccacccgggaggcgcagaagcgcacggccgccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggaccagctgggccctgtgcgaggcgctgacgctcgccaccggccccatcaccaccctgtgggagggctccccggggaagttctggaacacgaccatcgccgtcagcatggccaacatcttccgcggctcctacctggcgggggccggcctcgccttcagcatcatgaagtccgtggggaccggccggcgcggcaccgggagccagggcgagacgctgggggagaagtggaagaagaagctgaaccagctcagccggaaggagttcgacctgtacaagaagtccggcatcaccgaggtggaccgcaccgaggccaaggaggggctgaagcggggcgagaccacccaccacgccgtcagccgcggctccgcgaagctccagtggttcgtggagcggaacatggtgatccccgaggggcgcgtcatcgacctgggctgcgggcgcggcgggtggagctactactgcgccggcctgaagaaggtgacggaggtgcggggctacaccaagggcgggcccgggcacgaggagcccgtcccgatgtccacctacggctggaacctcgtgaagctgatgagcgggaaggacgtgttctacctgccgcccgagaagtgcgacaccctgctctgcgacatcggcgagtccagcccctccccgacggtcgaggagagccgcaccatccgggtgctgaagatggtggagccctggctgaagaacaaccagttctgcatcaaggtcctcaacccctacatgcccaccgtgatcgagcacctggagcgcctgcagcggaagtacggcgggatgctcgtgcgcaacccgctgtcccggaacagcacccacgagatgtactggatctccaacggcacggggaacatcgtcagctccgtgaacatggtgagccgcctgctcctgaaccggttcaccatgacccaccgccggcccaccatcgagaaggacgtcgacctgggcgccggcacgcgccacgtgaacgccgagcccgagaccccgaacatggacgtcatcggggagcggatcaagcgcatcaaggaggagcactccagcacctggcactacgacgacgagaacccctacaagacctgggcctaccacggctcctacgaggtgaaggcgacggggagcgccagctccatgatcaacggcgtggtcaagctcctgaccaagccctgggacgtggtgcccatggtcacccagatggccatgaccgacacgaccccgttcgggcagcagcgggtgttcaaggagaaggtggacacccgcacgccccggcccatgcccggcacgcgcaaggtcatggagatcaccgccgagtggctgtggcggaccctcggccgcaacaagaagccgcgcctgtgcacccgggaggagttcacgaagaaggtgcgcaccaacgccgcgatgggggccgtgttcaccgaggagaaccagtgggacagcgcccgggccgcggtcgaggacgaggagttctggaagctggtggaccgcgagcgggagctccacaagctgggcaagtgcgggtcctgcgtgtacaacatgatgggcaagcgcgagaagaagctgggggagttcggcaaggccaagggcagccgggccatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggcgatgtacgccgacgacaccgccggctgggacacgcggatcaccgaggacgacctgcacaacgaggagaagatcacccagcagatggaccccgagcaccgccagctggccaacgccatcttcaagctcacctaccagaacaaggtggtgaaggtccagcggcccacgccgaaggggaccgtgatggacatcatctcccgcaaggaccagcggggcagcggccaggtggggacctacggcctgaacaccttcaccaacatggaggcgcagctggtccgccagatggagggggagggcgtgctctccaaggccgacctggagaacccccacctcctcgagaagaagatcacgcagtggctggagaccaagggggtggagcggctgaagcgcatggccatcagcggcgacgactgcgtcgtgaagcccatcgacgaccggttcgccaacgccctcctggcgctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcccggatctcccagggcgccgggtggagcctcaaggagaccgcctgcctgggcaaggcctacgcgcagatgtggtccctgatgtacttccaccgccgggacctccgcctggccagcaacgccatctgctccgccgtcccggtgcactggatccccaccagccggacgacctggagcatccacgcgcaccaccagtggatgaccaccgaggacatgctgacggtgtggaaccgcgtctggatcgaggacaacccctggatggaggacaagacccccgtgaccacctgggaggacgtgccgtacctcggcaagcgggaggaccagtggtgcgggtccctgatcggcctgacgagccgcgccacctgggcccagaacatcctcaccgccatccagcaggtccggtccctgatcggggacgaggagttcctggactacatgcccagcatgaagcgcttccggaaggaggaggagtccgagggcgccatctggtga

SEQ ID NO: 10324 - RNA, 9873 nt, synthetic construct
  misc_feature 1..9873: note = derived and/or modified CDS sequence (opt1) from DENV-3__FJ547066__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgagatggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcggcaggtcgagaaggtggagacgtgggccctccgccacccggggttcaccatcctggcgctgttcctcgcccactacatcggcacctccctgacccagaaggtcgtgatcttcatcctgctcatgctggtgacgcccagcatgaccatgcggtgcgtcggggtgggcaaccgcgacttcgtggagggcctgtccggggccacctgggtcgacgtggtgctcgagcacggcgggtgcgtcaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtggaccgggggtggggcaacgggtgcggcctgttcgggaagggctccctggtgacctgcgccaagttccagtgcctcgagcccatcgagggcaaggtggtgcagtacgagaacctgaagtacaccgtcatcatcacggtgcacaccggggaccagcaccaggtgggcaacgacacccagggggtcaccgtggagatcacgccccaggccagcaccgtcgaggccgtgctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtgtccgagacccagcacgggacgatcctgatcaaggtcgagtacaagggcgaggacgccccgtgcaagatccccttcagcaccgaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacctggatcggcctgaacagcaagaacacgtccatgagcttctcctgcatcgtgatcgggatcatcaccctgtacctcggcgccgtggtccaggccgacatggggtgcgccatcaactggaagggcaaggagctgaagtgcggcagcgggatcttcgtgaccaacgaggtgcacacctggacggagcagtacaagttccaggcggactcccccaagcgcctggccaccgccatcgccggcgcctgggagaacggggtctgcggcatccgcagcaccacccggatggagaacctcctgtggaagcagatcgcgaacgagctgaactacatcctctgggagaacaacatcaagctgacggtggtggtcggggacatcatcggcgtgctggagcagggcaagcgcaccctcacgccccagccgatggagctgaagtactcctggaagacctgggggaaggccaagatcgtgacggccgagacccagaacagctccttcatcatcgacggccccaacacccccgagtgccccagcgcctcccgggcgtggaacgtctgggaggtggaggactacgggttcggcgtgttcaccacgaacatctggctgaagctccgcgaggtctacacccagagctgcgaccaccggctgatgagcgccgccatcaaggacgagcgcgccgtgcacgccgacatgggctactggatcgagtcccagaagaacgggagctggaagctggagaaggcgtccttcatcgaggtgaagacctgcacctggcccaagagccacaccctctggtccaacggcgtcctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtgatcacggagaactgcgggacccgcggcccctccctccggaccaccacggtcagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcctgttcaccttcgtgctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtcggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgccgctcctggcccctcaacgagggggtgatggccgtgggcctggtcagcatcctggcctccagcctcctgcggaacgacgtgcccatggccggcccgctggtggccggcgggctcctgatcgcctgctacgtcatcacggggacctccgccgacctgaccgtggagaaggccgccgacgtgacctgggaggaggaggcggagcagacgggggtcagccacaacctcatgatcaccgtggacgacgacgggaccatgcgcatcaaggacgacgagaccgagaacatcctgaccgtgctgctcaagacggccctgctgatcgtctccggcatcttcccctacagcatccccgccaccctcctggtgtggcacacctggcagaagcagacccagcggtccggcgtgctgtgggacgtccccagcccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggcgtccgtgaagaaggacctcatcagctacggcgggggctggcggctgtccgcccagtggcagaagggggaggaggtccaggtgatcgccgtggagcccggcaagaacccgaagaacttccagaccatgcccggcatcttccagaccaccacgggggagatcggcgccatcgcgctggacttcaagcccgggaccagcggcagcccgatcatcaaccgcgagggcaaggtcgtggggctgtacggcaacggggtggtcaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcgcccacgcgggtcgtggccgccgagatggaggaggccctgaaggggctgcccatccgctaccagaccaccgccaccaagtccgagcacacgggccgggagatcgtggacctcatgtgccacgcgaccttcaccatgcgcctgctgagcccggtccgggtgcccaactacaacctcatcatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgcgaacttcaaggccgaccgcgtcatcgacccccggcgctgcctgaagcccgtgatcctgaccgacggccccgagcgggtgatcctcgccgggccgatgcccgtcacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtggagctcatgcggcgcggggacctgcccgtctggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgtaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtgatcgtcagctccggcatgctgtggatggcggacgtgcccctgcagtggatcgccagcgccatcatcctcgagttcttcatgatggtgctgctgatccccgagcccgagaagcagcgcaccccgcaggacaaccagctcgcctacgtcgtgatcgggatcctgaccctggccgcgatcgtggccgccaacgagatgggcctcctggagacgaccaagcgggacctgggcatgtccaaggagcccggggtcgtgagccccacctcctacctcgacgtggacctgcaccccgccagcgcctggaccctgtacgcggtcgccacgaccgtgatcaccccgatgctccgccacaccatcgagaactccacggccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacccactacgccatcatcggcccgggcctgcaggccaaggccacgcgggaggcccagaagcgcaccgcggccgggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcggacgagctgggccctgtgcgaggccctgaccctcgcgaccggccccatcaccacgctgtgggagggctccccggggaagttctggaacaccaccatcgccgtgagcatggccaacatcttccgcggctcctacctggccggggcgggcctcgccttcagcatcatgaagtccgtcgggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtgagccgcggctccgccaagctccagtggttcgtcgagcggaacatggtgatccccgaggggcgcgtgatcgacctgggctgcgggcgcggcgggtggagctactactgcgcgggcctgaagaaggtcaccgaggtgcggggctacaccaagggcgggcccgggcacgaggagcccgtgccgatgtccacctacggctggaacctcgtcaagctgatgagcgggaaggacgtgttctacctgccgcccgagaagtgcgacacgctgctctgcgacatcggcgagtccagcccctccccgaccgtggaggagagccgcaccatccgggtcctgaagatggtggagccctggctgaagaacaaccagttctgcatcaaggtgctcaacccctacatgcccaccgtcatcgagcacctggagcgcctgcagcggaagtacggcgggatgctcgtgcgcaacccgctgtcccggaacagcacgcacgagatgtactggatctccaacggcaccgggaacatcgtgagctccgtcaacatggtgagccgcctgctcctgaaccggttcaccatgacccaccgccggcccacgatcgagaaggacgtggacctgggcgccggcacccgccacgtcaacgccgagcccgagaccccgaacatggacgtgatcggggagcggatcaagcgcatcaaggaggagcactccagcacctggcactacgacgacgagaacccctacaagacgtgggcctaccacggctcctacgaggtcaaggccaccgggagcgcgagctccatgatcaacggcgtggtgaagctcctgaccaagccctgggacgtcgtgcccatggtgacccagatggccatgacggacaccaccccgttcgggcagcagcgggtcttcaaggagaaggtggacacccgcacgccccggcccatgcccggcacccgcaaggtgatggagatcaccgccgagtggctgtggcggaccctcggccgcaacaagaagccgcgcctgtgcacgcgggaggagttcaccaagaaggtccgcaccaacgccgccatgggggcggtgttcaccgaggagaaccagtgggacagcgcccgggccgccgtggaggacgagggcttctggaagctggtcgaccgcgagcgggagctccacaagctggggaagtgcggctcctgcgtgtacaacatgatggggaagcgcgagaagaagctgggcgagttcggcaaggcgaaggggagccgggccatctggtacatgtggctcggcgcccgctacctggagttcgaggccctggggttcctcaacgaggaccactggttctcccgggagaacagctactccggcgtggagggggagggcctgcacaagctgggctacatcctccgcgacatcagcaagatccccgggggcgccatgtacgcggacgacacggccgggtgggacacccggatcaccgaggacgacctgcacaacgaggagaagatcacccagcagatggaccccgagcaccgccagctggccaacgccatcttcaagctcacgtaccagaacaaggtcgtgaaggtgcagcggcccaccccgaagggcaccgtcatggacatcatctcccgcaaggaccagcggggcagcggccaggtgggcacctacgggctgaacaccttcacgaacatggaggcccagctggtgcgccagatggagggcgagggggtcctctccaaggcggacctggagaacccccacctcctcgagaagaagatcacccagtggctggagaccaagggcgtggagcggctgaagcgcatggccatcagcggcgacgactgcgtggtcaagcccatcgacgaccggttcgccaacgccctcctggccctgaacgacatggggaaggtgcgcaaggacatcccccagtggcagccgtccaagggctggcacgactggcagcaggtccccttctgcagccaccacttccacgagctcatcatgaaggacgggcggaagctggtcgtgccctgccgcccccaggacgagctgatcggccgcgcgcggatctcccagggggccggctggagcctcaaggagaccgcctgcctgggcaaggcctacgcccagatgtggtccctgatgtacttccaccgccgggacctccgcctggcgagcaacgccatctgctccgccgtgccggtccactggatccccacgagccggaccacctggagcatccacgcccaccaccagtggatgaccacggaggacatgctgaccgtgtggaaccgcgtgtggatcgaggacaacccctggatggaggacaagacccccgtcaccacgtgggaggacgtgccgtacctcgggaagcgggaggaccagtggtgcggctccctgatcgggctgaccagccgcgcgacctgggcccagaacatcctcaccgccatccagcaggtccggtccctgatcggcgacgaggagttcctggactacatgcccagcatgaagcgcttccggaaggaggaggagtccgagggggccatctggtga

SEQ ID NO: 10325 - RNA, 9873 nt, synthetic construct
  misc_feature 1..9873: note = derived and/or modified CDS sequence (opt1) from DENV-3__KF955460__SS-prME
  source 1..9873: mol_type = other RNA
accagcctgtgcctcatgatgatgctgcccgcgaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacctgggccctccgccacccggggttcaccatcctggcgctgttcctcgcccactacatcggcacctccctgacccagaaggtggtgatcttcacgctgctcatgctggtcacccccagcatgaccatgcggtgcgtgggggtgggcaaccgcgacttcgtcgagggcctgtccggggccacctgggtggacgtggtcctcgagcacggcgggtgcgtgacgaccatggccaagaacaagcccaccctggacatcgagctgcagaagaccgaggccacgcagctcgcgaccctgcggaagctgtgcatcgagggcaagatcaccaacatcaccacggacagccgctgccccacccagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggccagcaccgtggaggccgtgctgcccgagtacggcaccctcgggctggagtgctccccgcgcaccggcctggacttcaacgagatgatcctcctgacgatgaagaacaaggcgtggatggtccaccggcagtggttcttcgacctgcccctcccctggaccagcggcgccaccaccgagacgcccacctggaaccgcaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccggctcaagatggacaagctggagctgaagggcatgagctacgccatgtgcctcaacaccttcgtgctgaagaaggaggtctccgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagagcaacatcgtgatcggcatcgggaacaaggccctcaagatcaactggtacaagaagggctccagcatcgggaagatgttcgaggcgaccgcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacgtggaccgagcagtacaagttccaggcggactcccccaagcgcctggccaccgccatcgccggcgcctgggagaacggggtgtgcggcatccgcagcaccacgcggatggagaacctcctgtggaagcagatcgcgaacgagctgaactacatcctctgggagaacaacatcaagctgaccgtggtcgtgggggacatcatcggcgtgctggagcagggcaagcgcaccctcacgccccagccgatggagctgaagtactcctggaagacgtgggggaaggccaagatcgtcaccgccgagacccagaacagctccttcatcatcgacggccccaacacccccgagtgccccagcgcctcccgggcgtggaacgtgtgggaggtggaggactacgggttcggcgtcttcacgaccaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacacgctctggtccaacggcgtgctggagagcgacatgatcatccccaagtccctggccgggcccatcagccagcacaaccaccggccgggctaccacacccagaccgccgggccctggcacctcggcaagctggagctggacttcaactactgcgagggcaccacggtggtcatcaccgagaactgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcacgttcgtgctcctgctgtccggccagatcacctggcgcgacatggcccacaccctcatcatgatcggcagcaacgcctccgaccggatggggatgggcgtcacctacctggccctgatcgccacgttcaagatccagcccttcctcgcgctggggttcttcctgcgcaagctcaccagccgggagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgagcctgacgtgctccaacaccatcttcaccctgaccgtcgcctggcgcacggccaccctcatcctggccggggtgagcctgctcccgctgtgccagtccagctccatgcggaagaccgactggctgcccatgaccgtcgcggccatgggcgtgccgcccctgccgctgttcatcttcagcctgaaggacacgcccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcaccgggacctccgccgacctgaccgtggagaaggccgccgacgtcacgtgggaggaggaggcggagcagaccggggtgagccacaacctcatgatcaccgtggacgacgacgggaccatgcgcatcaaggacgacgagaccgagaacatcctgacggtcctgctcaagaccgccctgctgatcgtgtccggcatcttcccctacagcatccccgccaccctcctggtgtggcacacctggcagaagcagacgcagcggtccggcgtcctgtgggacgtgcccagcccgcccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagacgaacgccgagcccgacggccccacccccgagctcgaggaggagatgttcaagaagcggaacctgaccatcatggacctgcacccggggagcggcaagacccgcaagtacctccccgccatcgtccgggaggccatcaagcgccggctgcgcacgctgatcctcgcgcccacccgggtggtggccgccgagatggaggaggccctgaaggggctgcccatccgctaccagaccaccgccacgaagtccgagcacaccggccgggagatcgtcgacctcatgtgccacgcgaccttcaccatgcgcctgctgagcccggtgcgggtgcccaactacaacctcatcatcatggacgaggcccacttcacggaccccgcctccatcgccgcccgcgggtacatcagcacccgggtcggcatgggcgaggcggccgccatcttcatgaccgccacgccgcccgggacggcggaggccttcccccagtccaacgcccccatccaggacgaggagaaggacatccccgagcgcagctggaactccggcaacgagtggatcaccgacttcgtggggaagaccgtgtggttcgtccccagcatcaaggccggcaacgacatcgccaactgcctgcgcaagaacgggaagaaggtgatccagctgtcccggaagaccttcgacacggagtaccagaagacccgcctcaacgactgggacttcgtggtcaccaccgacatcagcgagatgggcgcgaacttcaaggccgaccgggtgatcgacccccgccggtgcctgaagcccgtgatcctgacggacggccccgagcgcgtcatcctcgccgggccgatgcccgtgaccgccgcctccgcggcccagcggcgcggccgggtggggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagacgttcgtcgagctcatgcgccgcggggacctgcccgtgtggctggcccacaaggtcgccagcgagggcatcaagtacaccgaccgcaagtggtgcttcgacggggagcggaacaaccagatcctcgaggagaacatggacgtggagatctggaccaaggagggcgagcgcaagaagctgcggccgcgctggctggacgcgcgcacctactccgaccccctcgccctgaaggagttcaaggacttcgccgccggccgcaagagcatcgccctggacctcgtgacggagatcgggcgcgtcccctcccacctggcgtaccggacccgcaacgccctggacaacctcgtgatgctgcacaccagcgagcacggcgggcgggcctaccgccacgccgtggaggagctgccggagaccatggagacgctcctgctgctcggcctgatgatcctgctcaccgggggcgccatgctgttcctgatcagcggcaaggggatcggcaagacctccatcgggctcatctgcgtcatcgtgagctccggcatgctgtggatggcggacgtgcccctgcagtggatcgccagcgccatcgtcctcgagttcttcatgatggtgctgctgatccccgagcccgagaagcagcggaccccgcaggacaaccagctcgcctacgtggtcatcgggatcctgacgctggccgcgatcgtggccgccaacgagatgggcctcctggagaccaccaagcgcgacctgggcatgtccaaggagcccggggtggtcagccccacctcctacctcgacgtggacctgcaccccgccagcgcctggacgctgtacgcggtggccaccaccgtcatcaccccgatgctccggcacacgatcgagaactccaccgccaacgtgagcctggccgcgatcgccaaccaggccgtggtcctgatgggcctcgacaaggggtggcccatctccaagatggacctgggcgtgcccctgctcgccctggggtgctacagccaggtgaaccccctgaccctcaccgccgcggtcctgctgctcgtgacgcactacgccatcatcggcccgggcctgcaggccaaggccacccgcgaggcccagaagcggaccgcggccgggatcatgaagaaccccaccgtggacggcatcatgacgatcgacctggaccccgtcatctacgactccaagttcgagaagcagctcggccaggtgatgctgctggtgctctgcgccgtccagctgctgctcatgcgcaccagctgggccctgtgcgaggccctgaccctcgcgaccggccccatcacgaccctgtgggagggctccccggggaagttctggaacaccaccatcgccgtgagcatggccaacatcttccggggctcctacctggccggggcgggcctcgccttcagcatcatgaagtccgtggggacgggccgccggggcaccgggagccagggcgagaccctgggggagaagtggaagaagaagctgaaccagctcagccgcaaggagttcgacctgtacaagaagtccggcatcaccgaggtcgaccggaccgaggccaaggaggggctgaagcgcggcgagacgacccaccacgccgtgagccggggctccgccaagctccagtggttcgtggagcgcaacatggtcatccccgaggggcgggtgatcgacctgggctgcgggcgcggcgggtggagctactactgcgcgggcctgaagaaggtgaccgaggtccgcggctacaccaagggcgggcccgggcacgaggagcccgtgccgatgtccacgtacggctggaacatcgtgaagctcatgagcgggaaggacgtcttctacctgccgcccgagaagtgcgacaccctgctgtgcgacatcggcgagtccagcccctccccgaccgtggaggagagccggaccatccgcgtgctcaagatggtcgagccctggctgaagaacaaccagttctgcatcaaggtgctgaacccctacatgcccacggtgatcgagcacctcgagcggctgcagcgcaagtacggcgggatgctggtccggaacccgctctcccgcaacagcacccacgagatgtactggatctccaacggcaccgggaacatcgtgagctccgtgaacatggtcagccggctgctgctcaaccgcttcaccatgacgcaccggcgccccaccatcgagaaggacgtggacctgggcgccggcacccggcacgtcaacgccgagcccgagaccccgaacatggacgtgatcggggagcgcatcaagcggatcaaggaggagcactccagcacgtggcactacgacgacgagaacccctacaagacctgggcctaccacggctcctacgaggtgaaggccaccgggagcgcgagctccatgatcaacggcgtcgtgaagctgctcaccaagccctgggacgtggtccccatggtgacgcagatggccatgaccgacaccaccccgttcgggcagcagcgcgtgttcaaggagaaggtcgacacgcggacgccccggcccatgcccggcacccggaaggtgatggagatcaccgccgagtggctgtggcgcacgctgggccggaacaagaagccgcgcctctgcacccgcgaggagttcaccaagaaggtgcggaccaacgccgccatgggggcggtcttcacggaggagaaccagtgggacagcgcccgcgccgccgtggaggacgaggagttctggaagctggtggaccgggagcgcgagctgcacaagctcggcaagtgcgggtcctgcgtctacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgcggacgacaccgccggctgggacacccgcatcaccgaggacgacctccacaacgaggagaagatcacgcagcagatggaccccgagcaccggcagctggccaacgccatcttcaagctgacctaccagaacaaggtggtcaaggtgcagcgccccaccccgaaggggaccgtgatggacatcatctcccggaaggaccagcgcggcagcggccaggtcgggacctacggcctcaacacgttcaccaacatggaggcccagctggtgcggcagatggagggggagggcgtgctgtccaaggcggacctcgagaacccccacctcctggagaagaagatcacccagtggctcgagaccaagggggtcgagcgcctgaagcggatggccatcagcggcgacgactgcgtggtgaagcccatcgacgaccgcttcgccaacgccctgctcgccctgaacgacatgggcaaggtccggaaggacatcccccagtggcagccgtccaaggggtggcacgactggcagcaggtccccttctgcagccaccacttccacgagctgatcatgaaggacggccgcaagctcgtggtcccctgccggccccaggacgagctgatcgggcgcgcgcgcatctcccagggcgccgggtggagcctgaaggagacggcctgcctcggcaaggcctacgcccagatgtggtccctgatgtacttccaccggcgcgacctgcggctcgcgagcaacgccatctgctccgccgtgccggtgcactggatccccaccagccgcaccacctggagcatccacgcccaccaccagtggatgacgaccgaggacatgctgaccgtctggaaccgggtgtggatcgaggacaacccctggatggaggacaagacccccgtgacgacctgggaggacatcccgtacctgggcaagcgcgaggaccagtggtgcgggtccctcatcggcctgaccagccgggcgacctgggcccagaacatcctgacggccatccagcaggtccgctccctcatcggggacgaggagttcctggactacatgcccagcatgaagcggttccgcaaggaggaggagtccgagggcgccatctggtga

SEQ ID NO: 10326 - RNA, 9873 nt, synthetic construct
  misc_feature 1..9873: note = derived and/or modified CDS sequence (opt1) from DENV-3__FJ461334__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccacccagtggcagaagggggaggaggtccaggtgatcgccgtcgagcccggcaagaacccgaagaacttccagaccatgcccggcatcttccagaccacgaccggggagatcggcgccatcgccctggacttcaagcccgggaccagcggcagcccgatcatcaaccgcgagggcaaggtggtggggctgtacggcaacggggtcgtgaccaagaacggcgggtacgtgtccggcatcgcgcagacgaacgccgagcccgacggccccacccccgagctcgaggaggagatgttcaagaagcggaacctgaccatcatggacctgcacccggggagcggcaagacccgcaagtacctccccgccatcgtccgggaggccatcaagcgccggctgcgcacgctgatcctcgcccccacccgggtggtggcggccgagatggaggaggccctgaaggggctgcccatccgctaccagaccaccgccacgaagtccgagcacaccggccgggagatcgtcgacctcatgtgccacgccaccttcaccatgcgcctgctgagcccggtgcgggtgcccaactacaacctcatcatcatggacgaggcgcacttcacggaccccgcctccatcgccgcccgcgggtacatcagcacccgggtcggcatgggcgaggccgcggccatcttcatgaccgccacgccgcccgggacggccgaggcgttcccccagtccaacgcccccatccaggacgaggagcgcgacatccccgagcgcagctggaactccggcaacgagtggatcaccgacttcgtggggaagaccgtgtggttcgtccccagcatcaaggccggcaacgacatcgccaactgcctgcggaagaacgggaagaaggtgatccagctgtcccgcaagaccttcgacacggagtaccagaagacccggctcaacgactgggacttcgtggtcaccaccgacatcagcgagatgggcgccaacttcaaggcggaccgcgtgatcgacccccggcgctgcctgaagcccgtgatcctgacggacggccccgagcgggtcatcctcgccgggccgatgcccgtgaccgccgcctccgccgcgcagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagacgttcgtcgagctcatgcggcgcggggacctgcccgtgtggctggcccacaaggtcgccagcgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcccggacctactccgaccccctcgcgctgaaggagttcaaggacttcgccgccggccgcaagagcatcgccctggacctcgtgacggagatcgggcgggtcccctcccacctggcctaccgcacccggaacgcgctggacaacctcgtgatgctgcacaccagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtcatcgtgagctccggcatgctgtggatggccgacgtgcccctgcagtggatcgcgagcgccatcatcctcgagttcttcatgatggtcctgctgatccccgagcccgagaagcagcgcaccccgcaggacaaccagctcgcctacgtggtgatcgggatcctgacgctggccgccatcgtcgcggccaacgagatgggcctcctggagaccaccaagcgggacctgggcatgtccaaggagcccggggtggtgagccccacctcctacctcgacgtcgacctgcaccccgccagcgcctggacgctgtacgccgtggcgaccaccgtgatcaccccgatgctccgccacacgatcgagaactccaccgccaacgtcagcctggccgccatcgcgaaccaggccgtggtgctgatgggcctcgacaaggggtggcccatctccaagatggacctgggcgtccccctgctcgccctggggtgctacagccaggtgaaccccctgaccctcaccgccgccgtgctgctgctcgtcacgcactacgcgatcatcggcccgggcctgcaggccaaggccacccgggaggcccagaagcgcaccgccgcggggatcatgaagaaccccaccgtggacggcatcatgacgatcgacctggaccccgtgatctacgactccaagttcgagaagcagctcgggcaggtcatgctgctggtgctctgcgccgtgcagctgctgctcatgcggaccagctgggccctgtgcgaggccctgaccctcgccaccggccccatcacgaccctgtgggagggctccccggggaagttctggaacaccaccatcgcggtcagcatggccaacatcttccgcggctcctacctggccggggccggcctcgcgttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagacgacccaccacgccgtcagccgcggctccgccaagctccagtggttcgtggagcggaacatggtgatccccgaggggcgcgtcatcgacctgggctgcgggcgcggcgggtggagctactactgcgccggcctgaagaaggtgaccgaggtgcggggctacaccaagggcggccccgggcacgaggagcccgtcccgatgtccacgtacggctggaacctcgtgaagctgatgagcgggaaggacgtgttctacctgccgcccgagaagtgcgacaccctgctctgcgacatcggcgagtccagcccctccccgaccgtcgaggagagccgcaccatccgggtgctgaagatggtggagccctggctgaagaacaaccagttctgcatcaaggtcctcaacccctacatgcccacggtgatcgagcacctggagcgcctgcagcggaagtacggcgggatgctcgtgcgcaacccgctgtcccggaacagcacccacgagatgtactggatctccaacggcaccgggaacatcgtcagctccgtgaacatggtgagccgcctgctcctgaaccggttcaccatgacgcaccgccggcccaccatcgagaaggacgtcgacctgggcgcgggcacccgccacgtgaacgccgagcccgagaccccgaacatggacgtcatcggggagcggatcaagcgcatcaaggaggagcactccagcacgtggcactacgacgacgagaacccctacaagacctgggcctaccacggctcctacgaggtgaaggccaccgggagcgccagctccatgatcaacggcgtggtcaagctcctgaccaagccctgggacgtggtgcccatggtcacgcagatggcgatgaccgacaccaccccgttcgggcagcagcgggtgttcaaggagaaggtggacacgcgcacgccccggcccatgcccggcacccgcaaggtcatggagatcaccgccgagtggctgtggcggacgctcggccgcaacaagaagccgcgcctgtgcacccgggaggagttcaccaagaaggtgcgcaccaacgccgccatgggggccgtgttcacggaggagaaccagtgggacagcgcgcgggccgccgtcgaggacgaggagttctggaagctggtggaccgcgagcgggagctccacaagctgggcaagtgcgggtcctgcgtgtacaacatgatgggcaagcgcgagaagaagctgggggagttcggcaaggccaagggcagccgggcgatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggccatgtacgccgacgacaccgcgggctgggacacccggatcaccgaggacgacctgcacaacgaggagaagatcacgcagcagatggaccccgagcaccgccagctggccaacgccatcttcaagctcacctaccagaacaaggtggtgaaggtccagcggcccaccccgaaggggaccgtgatggacatcatctcccgcaaggaccagcggggcagcggccaggtggggacctacggcctgaacacgttcaccaacatggaggcccagctggtccgccagatggagggggagggcgtgctctccaaggccgacctggagaacccccacctcctcgagaagaagatcacccagtggctggagaccaagggggtggagcggctgaagcgcatggcgatcagcggcgacgactgcgtcgtgaagcccatcgacgaccggttcgccaacgccctcctggccctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcccggatctcccagggcgcggggtggagcctcaaggagacggcctgcctgggcaaggcctacgcccagatgtggtccctgatgtacttccaccgccgggacctccgcctggccagcaacgcgatctgctccgccgtcccggtgcactggatccccaccagccggaccacctggagcatccacgcccaccaccagtggatgacgaccgaggacatgctgaccgtgtggaaccgcgtctggatcgaggacaacccctggatggaggacaagacccccgtgacgacctgggaggacgtgccgtacctcggcaagcgggaggaccagtggtgcgggtccctgatcggcctgaccagccgcgccacctgggcgcagaacatcctcacggccatccagcaggtccggtccctgatcggggacgaggagttcctggactacatgcccagcatgaagcgcttccggaaggaggaggagtccgagggcgccatctggtga

SEQ ID NO: 10327 - RNA, 9873 nt, synthetic construct
  misc_feature 1..9873: note = derived and/or modified CDS sequence (opt1) from DENV-3__FJ461337__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccatgggcggggtcctgaacagcctcggcaagatggtgcaccagatcttcgggtccgcgtacaccgccctgttcagcggcgtgtcctggatcatgaagatcggcatcggggtcctgctcacctggatcggcctgaacagcaagaacacgtccatgagcttctcctgcatcgtgatcgggatcatcaccctgtacctcggcgccgtggtccaggccgacatggggtgcgccatcaactggaagggcaaggagctgaagtgcggcagcgggatcttcgtgaccaacgaggtgcacacctggacggagcagtacaagttccaggcggactcccccaagcgcctggccaccgccatcgccggcgcctgggagaacggggtctgcggcatccgcagcaccacccggatggagaacctcctgtggaagcagatcgcgaacgagctgaactacatcctctgggagaacaacatcaagctgacggtggtggtcggggacatcatcggcgtgctggagcagggcaagcgcaccctcacgccccagccgatggagctgaagtactcctggaagacctgggggaaggccaagatcgtgacggccgagacccagaacagctccttcatcatcgacggccccaacacccccgagtgccccagcgcctcccgggcgtggaacgtctgggaggtggaggactacgggttcggcgtgttcaccacgaacatctggctgaagctccgcgaggtctacacccagagctgcgaccaccggctgatgagcgccgccatcaaggacgagcgcgccgtgcacgccgacatgggctactggatcgagtcccagaagaacgggagctggaagctggagaaggcgtccttcatcgaggtgaagacctgcacctggcccaagagccacaccctctggtccaacggcgtcctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtgatcacggaggactgcgggacccgcggcccctccctccggaccaccacggtcagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcctgttcaccttcgtgctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtcggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgccgctcctggcccctcaacgagggggtgatggccgtgggcctggtcagcatcctggcctccagcctcctgcggaacgacgtgcccatggccggcccgctggtggccggcgggctcctgatcgcctgctacgtcatcacggggacctccgccgacctgaccgtggagaaggccgccgacgtgacctgggaggaggaggcggagcagacgggggtcagccacaacctcatgatcaccgtggacgacgacgggaccatgcgcatcaaggacgacgagaccgagaacatcctgaccgtgctgctcaagacggccctgctgatcgtctccggcatcttcccctacagcatccccgccaccctcctggtgtggcacacctggcagaagcagacccagcggtccggcgtgctgtgggacgtccccagcccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggcgtccgtgaagaaggacctcatcagctacggcgggggctggcggctgtccgcccagtggcagaagggggaggaggtccaggtgatcgccgtggagcccggcaagaacccgaagaacttccagaccatgcccggcatcttccagaccaccgccggggagatcggcgcgatcgccctggacttcaagcccgggacgagcggcagcccgatcatcaaccgcgagggcaaggtcgtggggctgtacggcaacggggtggtcaccaagaacggcgggtacgtgtccggcatcgcccagaccaacgccgagcccgacggccccacccccgagctcgaggaggagatgttcaagaagcggaacctgacgatcatggacctgcacccggggagcggcaagacccgcaagtacctccccgccatcgtgcgggaggcgatcaagcgccggctgcgcaccctgatcctcgcccccacccgggtcgtggccgccgagatggaggaggccctgaaggggctgcccatccgctaccagacgaccgcgaccaagtccgagcacaccggccgggagatcgtggacctcatgtgccacgccacgttcaccatgcgcctgctgagcccggtccgggtgcccaactacaacctcatcatcatggacgaggcccacttcaccgaccccgcctccatcgccgcgcgcgggtacatcagcacccgggtgggcatgggcgaggccgccgccatcttcatgacggcgacgccgcccgggaccgccgaggccttcccccagtccaacgcccccatccaggacgaggagcgcgacatccccgagcgcagctggaactccggcaacgagtggatcaccgacttcgtcgggaagacggtgtggttcgtgcccagcatcaaggccggcaacgacatcgcgaactgcctgcggaagaacgggaagaaggtcatccagctgtcccgcaagaccttcgacaccgagtaccagaagacccggctcaacgactgggacttcgtggtgacgaccgacatcagcgagatgggcgccaacttcaaggccgaccgcgtcatcgacccccggcgctgcctgaagcccgtgatcctgaccgacggccccgagcgggtgatcctcgccgggccgatgcccgtcaccgccgcgtccgccgcccagcgccggggccgcgtggggcggaacccccagaaggagaacgaccagtacatcttcacgggccagcccctgaacaacgacgaggaccacgcccactggaccgaggccaagatgctgctcgacaacatcaacaccccggaggggatcatccccgcgctgttcgagcccgagcgcgagaagtccgccgccatcgacggcgagtaccggctgaagggcgagtcccgcaagaccttcgtggagctcatgcggcgcggggacctgcccgtctggctggcccacaaggtggcgagcgagggcatcaagtacaccgaccggaagtggtgcttcgacggggagcgcaacaaccagatcctcgaggagaacatggacgtcgagatctggacgaaggagggcgagcggaagaagctgcgcccgcgctggctggacgcccggacctactccgaccccctcgccctgaaggagttcaaggacttcgccgccggccgcaagagcatcgcgctggacctcgtgaccgagatcgggcgggtgccctcccacctggcctaccgcacccggaacgccctggacaacctcgtcatgctgcacacgagcgagcacggcgggcgcgcctaccggcacgccgtggaggagctgccggagaccatggagaccctcctgctgctcggcctgatgatcctgctcaccgggggcgcgatgctgttcctgatcagcggcaaggggatcggcaagacgtccatcgggctcatctgcgtgatcgtcagctccggcatgctgtggatggccgacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggcggccatcgtcgccgccaacgagatgggcctcctggagaccacgaagcgggacctgggcatgtccaaggagcccggggtggtgagccccacctcctacctcgacgtcgacctgcaccccgccagcgcgtggaccctgtacgccgtggccaccacggtgatcaccccgatgctccgccacaccatcgagaactccaccgccaacgtcagcctggcggccatcgccaaccaggccgtggtgctgatgggcctcgacaaggggtggcccatctccaagatggacctgggcgtccccctgctcgccctggggtgctacagccaggtgaaccccctgacgctcaccgcggccgtgctgctgctcgtcacccactacgccatcatcggcccgggcctgcaggccaaggccacccgggaggcgcagaagcgcacggccgccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggaccagctgggccctgtgcgaggcgctgacgctcgccaccggccccatcaccaccctgtgggagggctccccggggaagttctggaacacgaccatcgccgtcagcatggccaacatcttccgcggctcctacctggcgggggccggcctcgccttcagcatcatgaagtccgtggggaccggccggcgcggcaccgggagccagggcgagacgctgggggagaagtggaagaagaagctgaaccagctcagccggaaggagttcgacctgtacaagaagtccggcatcaccgaggtggaccgcaccgaggccaaggaggggctgaagcggggcgagaccacccaccacgccgtcagccgcggctccgcgaagctccagtggttcgtggagcggaacatggtgatccccgaggggcgcgtcatcgacctgggctgcgggcgcggcgggtggagctactactgcgccggcctgaagaaggtgacggaggtgcggggctacaccaagggcggccccgggcacgaggagcccgtcccgatgtccacctacggctggaacctcgtgaagctgatgagcgggaaggacgtgttctacctgccgcccgagaagtgcgacaccctgctctgcgacatcggcgagtccagcccctccccgacggtcgaggagagccgcaccatccgggtgctgaagatggtggagccctggctgaagaacaaccagttctgcatcaaggtcctcaacccctacatgcccaccgtgatcgagcacctggagcgcctgcagcggaagtacggcgggatgctcgtgcgcaacccgctgtcccggaacagcacccacgagatgtactggatctccaacggcacggggaacatcgtcagctccgtgaacatggtgagccgcctgctcctgaaccggttcaccatgacccaccgccggcccaccatcgagaaggacgtcgacctgggcgccggcacgcgccacgtgaacgccgagcccgagaccccgaacatggacgtcatcggggagcggatcaagcgcatcaaggaggagcactccagcacctggcactacgacgacgagaacccctacaagacctgggcctaccacggctcctacgaggtgaaggcgacggggagcgccagctccatgatcaacggcgtggtcaagctcctgaccaagccctgggacgtggtgcccatggtcacccagatggccatgaccgacacgaccccgttcgggcagcagcgggtgttcaaggagaaggtggacacccgcacgccccggcccatgcccggcacgcgcaaggtcatggagatcaccgccgagtggctgtggcggaccctcggccgcaacaagaagccgcgcctgtgcacccgggaggagttcacgaagaaggtgcgcaccaacgccgcgatgggggccgtgttcaccgaggagaaccagtgggacagcgcccgggccgcggtcgaggacgaggagttctggaagctggtggaccgcgagcgggagctccacaagctgggcaagtgcgggtcctgcgtgtacaacatgatgggcaagcgcgagaagaagctgggggagttcggcaaggccaagggcagccgggccatctggtacatgtggctcggggcccgctacctggagttcgaggccctgggcttcctcaacgaggaccactggttctcccgggagaacagctactccggggtcgagggcgaggggctgcacaagctgggctacatcctccgcgacatcagcaagatccccggcggggcgatgtacgccgacgacaccgccggctgggacacgcggatcaccgaggacgacctgcacaacgaggagaagatcacccagcagatggaccccgagcaccgccagctggccaacgccatcttcaagctcacctaccagaacaaggtggtgaaggtccagcggcccacgccgaaggggaccgtgatggacatcatctcccgcaaggaccagcggggcagcggccaggtggggacctacggcctgaacaccttcaccaacatggaggcgcagctggtccgccagatggagggggagggcgtgctctccaaggccgacctggagaacccccacctcctcgagaagaagatcacgcagtggctggagaccaagggggtggagcggctgaagcgcatggccatcagcggcgacgactgcgtcgtgaagcccatcgacgaccggttcgccaacgccctcctggcgctgaacgacatgggcaaggtgcgcaaggacatcccccagtggcagccgtccaaggggtggcacgactggcagcaggtccccttctgcagccaccacttccacgagctcatcatgaaggacggccggaagctggtggtgccctgccgcccccaggacgagctgatcgggcgcgcccggatctcccagggcgccgggtggagcctcaaggagaccgcctgcctgggcaaggcctacgcgcagatgtggtccctgatgtacttccaccgccgggacctccgcctggccagcaacgccatctgctccgccgtcccggtgcactggatccccaccagccggacgacctggagcatccacgcgcaccaccagtggatgaccaccgaggacatgctgacggtgtggaaccgcgtctggatcgaggacaacccctggatggaggacaagacccccgtgaccacctgggaggacgtgccgtacctcggcaagcgggaggaccagtggtgcgggtccctgatcggcctgacgagccgcgccacctgggcccagaacatcctcaccgccatccagcaggtccggtccctgatcggggacgaggagttcctggactacatgcccagcatgaagcgcttccggaaggaggaggagtccgagggcgccatctggtga
